US011136611B2

(12) United States Patent
Siegel et al.

(10) Patent No.: US 11,136,611 B2
(45) Date of Patent: *Oct. 5, 2021

(54) METHOD FOR THE PREPARATION OF (3E,7E)-HOMOFARNESIC ACID OR (3E,7E)-HOMOFARNESIC ACID ESTER

(71) Applicant: BASF SE, Ludwigshafen am Rhein (DE)

(72) Inventors: Wolfgang Siegel, Ludwigshafen am Rhein (DE); Melanie Weingarten, Ludwigshafen am Rhein (DE); Michael Breuer, Ludwigshafen am Rhein (DE); Mathias Schelwies, Ludwigshafen am Rhein (DE)

(73) Assignee: BASF SE, Ludwigshafen am Rhein (DE)

( * ) Notice: Subject to any disclaimer, the term of this patent is extended or adjusted under 35 U.S.C. 154(b) by 0 days.

This patent is subject to a terminal disclaimer.

(21) Appl. No.: 16/487,978

(22) PCT Filed: Feb. 23, 2018

(86) PCT No.: PCT/EP2018/054502
§ 371 (c)(1),
(2) Date: Aug. 22, 2019

(87) PCT Pub. No.: WO2018/154048
PCT Pub. Date: Aug. 30, 2018

(65) Prior Publication Data
US 2020/0123586 A1 Apr. 23, 2020

(30) Foreign Application Priority Data
Feb. 24, 2017 (EP) ..................... 17157974

(51) Int. Cl.
C12P 41/00 (2006.01)
C12P 7/40 (2006.01)
C12P 17/04 (2006.01)

(52) U.S. Cl.
CPC .............. *C12P 41/005* (2013.01); *C12P 7/40* (2013.01); *C12P 17/04* (2013.01); *C12Y 301/01003* (2013.01); *C12Y 504/99017* (2013.01)

(58) Field of Classification Search
CPC .... C12Y 301/01003; C12Y 504/99017; C07D 307/92; C12P 41/005; C12P 17/04; C12P 7/62; C12P 7/40; C12N 15/80; C12N 15/74; C12N 1/20
USPC ........ 435/198, 157, 166, 126, 320.1, 254.22
See application file for complete search history.

(56) References Cited

U.S. PATENT DOCUMENTS

| 5,274,134 A | 12/1993 | Bruns et al. |
| 6,596,520 B1 | 7/2003 | Friedrich et al. |
| 8,759,043 B2 | 6/2014 | Breuer et al. |
| 8,932,839 B2 | 1/2015 | Breuer et al. |
| 9,447,404 B2 | 9/2016 | Breuer et al. |
| 10,190,112 B2 | 1/2019 | Breuer et al. |
| 2019/0119665 A1 | 4/2019 | Breuer et al. |
| 2019/0144899 A1 | 5/2019 | Breuer et al. |

FOREIGN PATENT DOCUMENTS

| CA | 1242741 A | 10/1988 |
| DE | 10019377 A1 | 10/2001 |
| EP | 0146859 A2 | 7/1985 |
| EP | 1069183 A2 | 1/2001 |
| EP | 1149849 A1 | 10/2001 |
| EP | 17157950.1 | 2/2017 |
| EP | 3417067 A1 | 12/2018 |
| WO | WO-2010139719 A2 | 12/2010 |
| WO | WO-2012066059 A2 | 5/2012 |
| WO | WO-2016170099 A1 | 10/2016 |
| WO | WO-2017140909 A1 | 8/2017 |
| WO | WO-2018153727 A2 | 8/2018 |

OTHER PUBLICATIONS

Devos et al., Proteins: Structure, Function and Genetics, 2000, vol. 41: 98-107.*
Whisstock et al., Quarterly Reviews of Biophysics 2003, vol. 36 (3): 307-340.*
Witkowski et al., Biochemistry 38:11643-11650, 1999.*
Kisselev L., Structure, 2002, vol. 10: 8-9.*
U.S. Appl. No. 16/487,161, filed Aug. 20, 2019, Schelwies et al.
Irimescu et al., "Enzymatic kinetic resolution of primary alcohols by direct esterification in solvent-free system," J Mol Catal B 2004, 27, 69-73.
Saito et al., "Cyclization of E,E-homofarnesic acid and its related compounds," Chem Lett 1984, 4, 591-594.
Database CAPLUS, 1984, Database accession No. 1984:455367.
Seitz et al., "Synthesis of heterocyclic terpenoids by promiscuous squalene-hopene cyclases," Chembiochem A 2013, 14(4), 436-439.
Suen, W.C. et al., "Improved activity and thermostability of *Candida antarctica* lipase B by DNA family shuffling," Protein Eng Des Sel 2004, 17(2), 133-140. Epub Jan. 12, 2004.
Uppenberg et al., "The sequence, crystal structure determination and refinement of two crystal forms of lipase B from *Candida antarctica*," Structure 1994, 2, 293-308.

(Continued)

*Primary Examiner* — Robert B Mondesi
*Assistant Examiner* — Mohammad Y Meah
(74) *Attorney, Agent, or Firm* — Faegre Drinker Biddle & Reath LLP

(57) ABSTRACT

The invention provides an improved method of isolating the 3-(E)-isomer of an unsaturated carboxylic acid from a mixture of corresponding (E/Z)isomers. More particularly, the present invention relates to an improved method for the biocatalytic preparation of (3E,7E)-homofarnesylic acid; as well as a novel biocatalytic method for the improved preparation of homofarnesol, in particular of (3E,7E)-homofarnesol and homofarnesol preparations having an increased content of (3E,7E)-homofarnesol. The present invention also relates to methods of preparing(−)-ambroxby applying (3E,7E)-homofarnesylic acid or (3E,7E)-homofarnesol as obtained according to the invention as starting material.

13 Claims, No Drawings

Specification includes a Sequence Listing.

(56) References Cited

OTHER PUBLICATIONS

International Search Report for PCT/EP2018/054502 dated Jun. 6, 2018.
Written Opinion of the International Searching Authority for PCT/EP2018/054502 dated Jun. 6, 2018.
Patkar et al., 1998, Effect of mutations in *Candida antarctica* B lipase, Chem. Phys Lipids 93(102):95-101. doi: 10.1016/s0009-3084(98)00032-2, Abstract.
Zhang et al., 2003, 'Improving tolerance of *Candida antarctica* lipase B towards irreversible thermal inactivation through directed evolution', Protein Engineering, Design and Selection, 16(8):599-605.

* cited by examiner

METHOD FOR THE PREPARATION OF (3E,7E)-HOMOFARNESIC ACID OR (3E,7E)-HOMOFARNESIC ACID ESTER

CROSS-REFERENCE TO RELATED APPLICATIONS

This application is a national stage application (under 35 U.S.C. § 371) of PCT/EP2018/054502, filed Feb. 23, 2018, which claims benefit of European Application No. 17157974.1, filed Feb. 24, 2017, both of which are incorporated herein by reference in their entirety.

BACKGROUND OF THE INVENTION

Ambrox® is the tradename of the enantiomerically pure compound (−)-Ambrox (3aR,5aS,9aS,9bR)-3a,6,6,9a-tetramethyldodecahydronaphtho[2,1-b] furan) which is used as valuable fragrance. Naturally occurring (−)-Ambrox is a constituent of ambra, a digestive product of pot whales.

(−)-Ambrox may be synthesized by applying chemical and/or of enzymatic reaction steps (see Scheme 1)

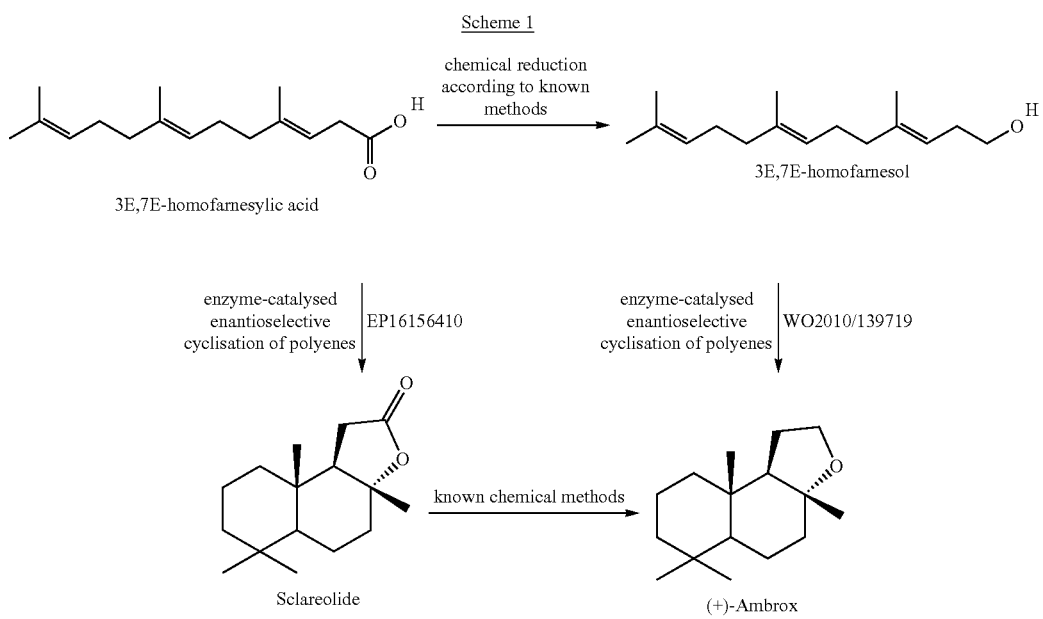

SUBMISSION OF SEQUENCE LISTING

The Sequence Listing associated with this application is filed in electronic format via EFS-Web and hereby incorporated by reference into the specification in its entirety. The name of the text file containing the Sequence Listing is 074012_0408_592345_ST25. The size of the text file is 1,583,538 bytes and the text file was created on Aug. 21, 2019.

The invention provides an improved method of isolating the 3-(E)-isomer of an unsaturated carboxylic acid from a mixture of corresponding (E/Z)isomers. More particularly, the present invention relates to an improved method for the biocatalytic preparation of (3E,7E)-homofarnesylic acid; as well as a novel biocatalytic method for the improved preparation of homofarnesol, in particular of (3E,7E)-homofarnesol and homofarnesol preparations having an increased content of (3E,7E)-homofarnesol (also designated as "all-E-homofarnesol"). The present invention also relates to methods of preparing (−)-ambrox by applying (3E,7E)-homofarnesylic acid or (3E,7E)-homofarnesol as obtained according to the invention as starting material.

(3E,7E)-homofarnesylic acid or (3E,7E)-homofarnesol stereochemically pure form are the most preferred starting materials form enzyme-bases synthetic routes, as they allow the biosynthesis of (−)-ambrox with the correct stereochemistry.

Mixtures of the isomers (3E,7E)- and (3Z,7E)-homofarnesylic acid are available. However, it is very difficult to separate such mixture of isomers in view of the high similarity between said two isomers. Separation by means of classical methods like distillation and chromatography is, therefore, quite laborious.

It is, therefore an object of the present invention to provide methods which allow a simpler access to stereoisomerically pure (3E,7E)-homofarnesylic acid and/or (3E,7E)-homofarnesol, or at least to preparations with an increased content of (3E,7E)-homofarnesylic acid or (3E,7E)-homofarnesol.

SUMMARY OF THE INVENTION

The above-mentioned problems could, surprisingly, be solved by providing enzymatically catalyzed methods of selectively preparing 3E-iomers of unsaturated carboxylic acids, as exemplified by the 3E,7E isomer of homofarnesylic acid, by applying certain lipase (E.C. 3.1.1.3) enzymes.

Surprisingly, it has been found in a first particular aspect of the invention that by applying the enzymatic activity of a lipase, as for example a lipase from *Candida antarctica*, the (3E,7E)-isomer of the free homofarnesylic acid is much more rapidly esterified in the presence of an alcohol than the corresponding (3Z,7E)-isomer. According to this first aspect of the invention, mixtures of (3E,7E)-homofarnesylic acid ester and free 3Z,7E-homofarnesylic acid are obtained. In view of the significant chemical differences between acid and ester, a very efficient and simple separation via extraction or distillation is now possible. Chemical saponification of the thus isolated (3E,7E)-homofarnesylic acid ester yields the desired free 3E,7E)-homofarnesylic acid Surprisingly, it has also been found in a second particular aspect of the invention that by applying the enzymatic activity of a lipase, as for example a lipase from *Candida antarctica*, the (3E,7E)-isomer of the homofarnesylic acid ester is much more rapidly saponified in the presence of water than the corresponding (3Z,7E)-isomer. According to this second aspect of the invention, mixtures of (3E,7E)-homofarnesylic acid and 3Z,7E-homofarnesylic acid ester are obtained. In view of the significant chemical differences between acid and ester, a very efficient and simple separation via extraction or distillation is now possible.

The following Scheme 2 illustrates said two aspects of the present invention:

Left-handed sclareolide shows the following structural formula:

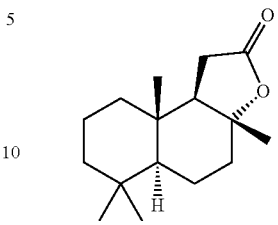

"Ambrox", "Ambroxan" and "Ambroxid" are used as synonyms. They include all stereoisomeric forms, such as, in particular. (+) Ambrox, 3a-epi-(−)Ambrox, 9b-epi-(−) Ambrox and in particular (−) Ambrox.

According to the invention, the term "lipase" means enzymes of class E.C. 3.1.1.3 according to the IUBMB enzyme nomenclature (www.iubmb.unibe.ch; www.chem.qmul.ac.uk/iubmb/enzyme/).

According to a special embodiment of the method according to the invention, the lipase is lipase B, the gene product of CALB from *Candida antarctica*. The CALB gene was described previously (Uppenberg J., Hansen, M. T., Patkar,

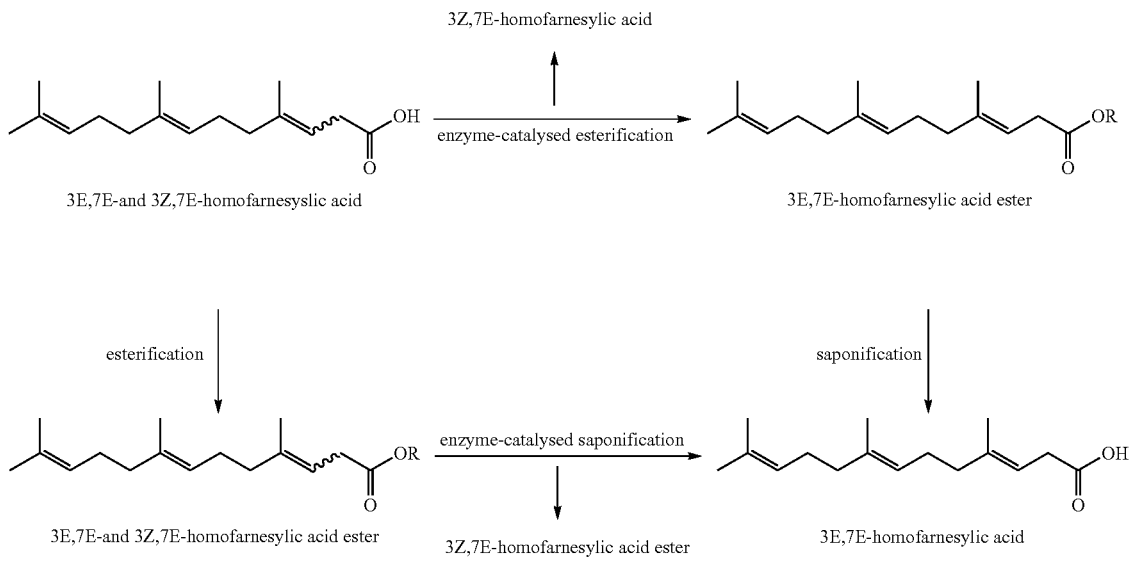

Scheme 2

DETAILED DESCRIPTION OF THE INVENTION

1. General Definitions

In the absence of information to the contrary the following general definitions shall apply:

"Homofarnesylic acid" or "homofarnesoic acid" are synonyms for "(3E,7E)-4,8,12-trimethyltrideca-3,7,11-trienic acid" or "(3Z,7E)-4,8,12-trimethyltrideca-3,7,11-trienic acid" or mixtures of said E/Z isomers.

"Sclareolid" is used as synonym for "(3aR,5aS,9aS,9bR)-3a,6,6,9a-tetramethyl-1,4,5,5a,7,8,9,9b-octahydrobenzo[e] benzofuran-2-one".

S., Jones, A., *Structure* 2: 293-308 (1994)) and its nucleotide or protein sequence was deposited under the access numbers Z30645 and CAA83122.1 at GenBank. Unless designated more precisely, here CALB means a nucleotide sequence with this access number. Another example of a triacylglycerol lipase is lipase B from Pseudozyma tsukubaensis (Suen, W. C., Zhang, N., Xiao, L, Madison, V., Zaks, A. *Protein Eng. Des. Sel.* 17(2): 133-40 (2004)).

For the purposes of the present invention; "cyclases" are generally enzymes or enzyme mutants, which in particular exhibit the activity of a homofarnesylic acid cyclase and/or of a homofarnesol cyclase. As enzymes with the activity of a homofarnesylic acid cyclase or homofarnesol cyclase are intramolecular transferases from the subclass of the isomerases; i.e. proteins with the EC number EC 5.4 are suitable. (Enzyme code according to Eur. J. Biochem, 1999, 264, 610-650). In particular, these are members of the class EC 5.4.99.17, Suitable enzymes having the activity of a homofamesylic acid cyclase or homofarnesol cyclase are, in particular, those cyclases which also effect the cyclization of homofarnesylic acid to sclareolide and/or of squalene to hopene (hence also sometimes referred to as "SHC" or squalene-hopene cyclase) and which are described extensively in the International Patent Application WO2010139719, which is incorporated herein by reference. Mutants thereof are, for example, described in WO 2012/066059, which is expressly incorporated herein by reference.

The term "cyclase activity" describes an enzyme activity determined with a "reference substrate under standard conditions", and which describes the formation of a cyclic product from a non-cyclic substrate. Standard conditions are e.g. substrate concentrations of 10 mM to 0.2 M, especially 15 to 100 mM, e.g. about 20 to 25 mM; at pH 4 to 8, and at temperatures of e.g. 15 to 30 or 20 to 25° C. The determination can be carried out with recombinant cyclase-expressing cells, digested cyclase-expressing cells, fractions thereof or enriched or purified cyclase enzyme. In particular, a reference substrate is a (3E,7E)-homofarnesylic acid.

"Yield" and/or the "conversion rate" of a reaction according to the invention is determined over a defined period of, for example, 4, 6, 8, 10, 12, 16, 20, 24, 36 or 48 hours, in which the reaction takes place. In particular, the reaction is carried out under precisely defined conditions, for example at 25, 30, 40, 50 or 60° C.

An "enzymatically catalyzed" or "biocatalytic" method means that said method is performed under the catalytic action of an enzyme, including enzyme mutants, as herein defined. Thus the method can either be performed in the presence of said enzyme in isolated (purified, enriched) or crude form or in the presence of a cellular system, in particular, natural or recombinant microbial cells containing said enzyme in active form, and having the ability to catalyze the conversion reaction as disclosed herein.

The terms "selectively converting" or "increasing the selectivity" in general means that a particular stereoisomeric form, i.p. the 3E-form, of an unsaturated carboxylic acid as herein defined, is converted in a higher proportion or amount (compared on a molar basis) than the corresponding 3Z-form, either during the entire course of said reaction (i.e. between initiation and termination of the reaction), at a certain point of time of said reaction, or during an "interval" of said reaction. In particular, said selectivity may be observed during an "interval" corresponding 1 to 99%, 2 to 95%, 3 to 90%, 5 to 85%, 10 to 80%, 15 to 75%, 20 to 70%, 25 to 65%, 30 to 60, or 40 to 50% conversion of the initial amount of the substrate. Said higher proportion or amount may, for example, be expressed in terms of:
a higher maximum yield of the 3E-isomer observed during the entire course of the reaction or said interval thereof;
a higher relative amount of the 3E-isomer at a defined % degree of conversion value of the substrate; and/or
an identical relative amount of the 3E-isomer at a higher % degree of conversion value; each of which preferably being observed relative to a reference method, said reference method being performed under otherwise identical condition with chemical means, as for example chemical esterification or chemical ester cleavage.

The term "about" indicates a potential variation of ±25% of the stated value, in particular ±15%, ±10%, preferably ±5%, ±2% or ±1%.

The term "substantially" describes a range of values of from about 80 to 100%, such as, for example, 85-99.9%, in particular 90 to 99.9%, preferably 95 to 99.9%, or 98 to 99.9% Especially 99 to 99.9%.

"Predominantly" refers to a proportion in the range of above 50%, as for example in the range of 51 to 100%, preferably in the range of 75 to 99.9%; more particularly 85 to 98.5%, like 95 to 99%.

Because of the reversibility of enzymatic reactions, the present invention relates to the enzymatic reactions described herein in both directions of reaction.

"Functional mutants" of herein described enzymes include the "functional equivalents" of such enzymes as defined below.

The term "stereoisomers" includes in particular conformational isomers.

Included in general are, according to the invention, all stereoisomeric forms of the compounds described herein, such as constitutional isomers and, in particular, stereoisomers and mixtures thereof, e.g. optical isomers, or geometric isomers such as E and Z isomers, and combinations thereof. If several asymmetric centers are present in one molecule, the invention encompasses all combinations of different conformations of these asymmetry centers, e.g. enantiomeric pairs "Stereoselectivity" describes the ability to produce a particular stereoisomer of a compound in a stereoisomerically pure form or to specifically convert a particular stereoisomer in an enzymatically catalyzed method as described herein out of a plurality of stereoisomers. More specifically, this means that a product of the invention is enriched with respect to a specific stereoisomer. This may be quantified via the purity % ee-parameter calculated according to the formula:

$$\% \ ee = [X_A - X_B] / [X_A + X_B] * 100,$$

wherein $X_A$ and $X_B$ represent the molar ratio (Molenbruch) of the stereoisomers A and B.

"E-stereoselectivity" or "E-selectivity" describes the ability to produce an E-Isomer of an at least one-fold unsaturated at a particular C=C-double bond in an E-isomerically pure or essentially pure or enriched form or to specifically or essentially specifically convert an E-isomer in an enzymatically catalyzed method as described herein out of a plurality of other isomers or a mixture of E- and Z-isomers at said particular position of the double-bond within s The above definition for stereoselectivity and its calculation applies in analogy also to the term "enantioselecitivity"

Stereoisomeric or enantiomeric purities of at least 90% ee, like at least 95% ee, or at lest 98% ee, or at east 99% ee or more may be obtained according to the invention.

Unless otherwise stated, the following general chemical definitions apply:

The term "carboxylic acid" encompasses both the free acid and the salt form thereof, e.g. their alkali metal or alkaline earth metal salts. This applies accordingly to all carboxylic acids mentioned herein, in particular homofarnesylic acid.

A linear or branched, saturated or non-saturated, "hydrocarbyl" residue according to the present invention particularly refers to linear or branched, alkyl or alkenyl residues.

An "alkyl" residue comprises $C_1$-$C_{20}$-alkyl radicals which are linear or branched radicals having from 1 to 20 carbon atoms or $C_1$-$C_4$-alkyl radicals or $C_4$-$C_{20}$-alkyl radicals. Examples thereof are:

$C_1$-$C_4$-alkyl radicals selected from methyl, ethyl, n-propyl, isopropyl, n-butyl, 2-butyl, isobutyl or tert-butyl, $C_1$-$C_6$-alkyl radicals selected from the $C_1$-$C_4$-alkyl radicals as defined above, pentyl, 1-methylbutyl, 2-methylbutyl, 3-methylbutyl, 2,2-dimethylpropyl, 1-ethylpropyl, hexyl, 1,1-dimethylpropyl, 1,2-dimethylpropyl, 1-methylpentyl, 2-methylpentyl, 3-methylpentyl, 4-methylpentyl, 1,1-dimethylbutyl, 1,2-dimethylbutyl, 1,3-dimethylbutyl, 2,2-dimethylbutyl, 2,3-dimethylbutyl, 3,3-dimethylbutyl, 1-ethylbutyl, 2-ethylbutyl, 1,1,2-trimethylpropyl, 1,2,2-trimethylpropyl, 1-ethyl-1-methylpropyl, 1-ethyl-2-methylpropyl;

$C_7$-$C_{20}$-alkyl radicals which are linear or branched radicals having from 7 to 20 carbon atoms; examples thereof being selected from heptyl, octyl, nonyl, decyl, undecyl, dodecyl, tridecyl, tetradecyl, pentadecyl, hexadecyl, heptadecyl, octadecyl, nonadecyl, eicosyl, and their constitutional isomers, as for example 4,8-dimethynonyl.

An "alkenyl" residue comprises $C_2$-$C_{20}$-alkenyl radicals which are mono- or polyunsaturated, in particular 1-, 2-, 3- or 4-fold, preferably 1-2- or 3-fold unsaturated linear or branched hydrocarbon radicals having from 2 to 20 carbon atoms.

Examples of mono-unsaturated $C_2$-$C_{20}$-alkenyl residues, with a position of the double bond in any position within the hydrocarbon chain are vinyl, 2-propene-1-yl, 1-methylprop-2-ene-1-yl, 2-butene-1-yl, 3-butene-1-yl, n-pentenyl, n-hexenyl, n-heptenyl, n-octenyl, n-nonenyl, n-decenyl, n-undecenyl, n-dodecenyl, n-tridecenyl, n-tetradecenyl, n-pentadecenyl, n-hexadecenyl, n-heptadecenyl, n-octadecenyl, oleyl, n-nonadecenyl, n-eicosenyl;

Examples of di- or tri-unsaturated $C_4$-$C_{20}$-alkenyl residues with two or three double, preferably non-cumulated and preferably non-conjugated bounds in a any position of the hydrocarbon chain are sind n-butadienyl, n-pentadienyl, n-hexadienyl, n-heptadienyl, n-octadienyl, n-octatrienyl, n-nonadienyl, n-nonatrienyl, n-decadienyl, n-decatrienyl, n-undecadienyl, n-undecatrienyl, n-dodecadienyl, n-dodecatrienyl, n-tridecadienyl, n-tridecatrienyl, n-tetradecadienyl n-tetradecatrienyl, n-pentadecadienyl, n-pentadecatrienyl, n-hexadecadienyl, n-hexadecatrienyl, n-heptadecadienyl, n-heptadecatrienyl, n-octadecadienyl, n-octadecatrienyl, n-nonadecadienyl, n-nonadecatrienyl, n-eicosadienyl, n-eicosatrienyl, and the constitutional isomers thereof, as for example 4,8-dimethylnona-3,7-dienyl.

Each double bond within the above $C_2$-$C_{20}$-alkenyl residue may, unless otherwise stated, take the E- or the Z-configuration, and independently of the other double bond in the case of polyunsaturation.

Non-limiting examples of "optionally substituted" residues as defined herein comprise 1, 2, 3, 4, 5 or 6, preferably 1 or 2 identical or different substituents like, HO, SH, $NH_2$, $NO_2$, halogen, like F, Cl, Br, J; lower alkyl, lower alkoxy, lower alkylthio, lower alkyl, lower alkenyl, lower alkynyl or hydroxyl-lower alkyl, as defined above.

"Lower alkyl" refers to $C_1$-$C_4$-alkyl radicals as defined above.

"Lower alkoxy" preferably refers to the $C_1$-$C_4$-alkoxy analogues of the above-mentioned lower alkyl radicals.

"Lower alkylthio" preferably refers to the $C_1$-$C_4$-alkthio analogues of the above-mentioned lower alkyl radicals. Examples are methylthio, ethylthio, propylthio, isopropylthio, butylthio, sec-butylthio, isobutylthio and tert-butylthio.

"Lower alkenyl" comprises $C_2$-$C_4$-alkenyl radicals as defined above.

"Lower alkynyl" comprises the alkynyl homologues of the above "lower alkeny" radicals.

The term "hydroxy lower-alkyl" refers to $C_1$-$C_4$-hydroxyalkyl which is a linear or branched alkyl radical having from 1 to 4 carbon atoms, in which at least one hydrogen atom, for example 1 or 2 of the hydrogen atoms, is/are replaced by a hydroxyl group. Examples thereof are hydroxymethyl, 2-hydroxy-1-ethyl, 2- and 3-hydroxy-1-propyl, 2-, 3- and 4-hydroxy-1-butyl, and their constitutional isomers.

Herein disclosed are parameter ranges of different degree of preference for a particular parameter. Within the scope of the present disclosure is also any combination of parameter ranges of different degree of preference for any combination of two or more parameter referred to herein.

2. Particular Embodiments of the Invention

The present invention provides the following particular embodiments:

1. A method for isolating the 3-(E)-isomer of an unsaturated carboxylic acid compound of the general formula (I)

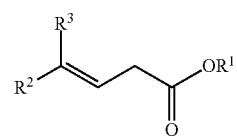

(I)

wherein $R^1$ is H or a straight chain or branched, saturated or unsaturated, optionally substituted $C_1$-$C_{20}$ hydrocarbyl residue, preferably a saturated, non-substituted straight chain $C_1$-$C_{20}$ hydrocarbyl residue;

$R^3$ is H or a $C_1$-$C_4$-hydrocarbyl residue, preferably H or methyl;

$R^2$ is a straight chain or branched, saturated or unsaturated, optionally substituted, $C_1$-$C_{20}$-hydrocarbyl residue, preferably a non-saturated, branched chain $C_2$-$C_{16}$-hydrocarbyl residue;

with the proviso that, if $R^3$ is a $C_1$-$C_4$-hydrocarbyl residue, $R^2$ represents an hydrocarbyl residue containing at least one additional carbon atom;

from a mixture of isomers comprising the 3-(E)- and 3-(Z)-isomer of said carboxylic acid compound, whereby said mixture of isomers is subjected to a lipase (E.C. 3.1.1.3) catalyzed enzymatic conversion reaction, which lipase preferentially, in particular stereoselectively, converts said 3-(E)-isomer, and the conversion product of said 3-(E)-isomer is isolated from said reaction mixture.

2. The method of embodiment 1, wherein said lipase catalyzes a 3-(E)-stereoselective conversion reaction.

3. The method of one of the preceding embodiments, wherein the lipase is applied in free or immobilized form.

4. The method of one of the preceding embodiments, wherein said lipase is a natural or recombinantly produced, optionally genetically modified (mutated) enzyme.

5. The method of one of the preceding embodiments, wherein said lipase originates from *Candida* sp., in particular *Candida antarctica*.

6. The method of embodiment 5, wherein said lipase is *Candida antarctica*. lipase B (CALB) comprising an amino acid sequence of SEQ ID NO:330 or a mutant thereof having a sequence identity of at least 60% to SEQ ID NO:330 and retaining said 3-(E)-selectivity.

7. The method of one of the preceding embodiments, wherein said conversion reaction comprises an enzymatic esterification reaction of an acid of the formula (Ia);

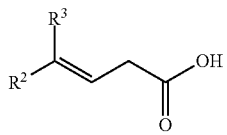
(Ia)

wherein
$R^2$ and $R^3$ are as defined above;
and wherein the 3-(E)-ester is predominantly formed; and wherein an aliphatic alkanol $R^1OH$, wherein $R^1$ is as defined above, preferably a straight chain or branched, saturated $C_1$-$C_{20}$ alkyl preferably $C_1$-$C_4$ alkyl residue, optionally in the presence of an organic solvent which does not disturb or even inhibit lipase activity.

8. The method of one of the embodiments 1 to 6, wherein said conversion reaction comprises an enzymatic ester cleavage reaction of an ester of the formula (Ib);

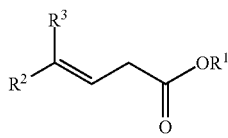
(Ib)

wherein
$R^1$ is H or a straight chain or branched, saturated or unsaturated $C_1$-$C_{20}$-, in particular $C_4$-$C_{20}$-, hydrocarbyl residue;
and $R^2$ and $R^3$ are as defined above;
and wherein the 3-(E)-acid is predominantly formed; and wherein the reaction is performed in the presence of water, and optionally in the presence of an organic solvent, which does not disturb or even inhibit lipase activity.

9. The method of one of the preceding embodiments, wherein said conversion reaction is performed in an organic solvent or aqueous-organic solvent.

10. The method of embodiment 9, wherein said organic solvent is selected from aliphatic or cycloaliphatic hydrocarbons, like hydrocarbons having at least 5 carbon atoms, in particular hexane, cyclohexane, heptane, octane; aromatic hydrocarbons, in particular mononuclear aromatic compounds, like benzene, xylene and toluene; and aliphatic ethers, like MTBE, diisopropyl ether. Preferably, suitable organic solvents should be able to form a 2-phase system with water.

11. The method of one of the preceding embodiments, wherein said carboxylic acid compound is a 3-(E)/7-(E)-homofarnesoic acid compound of formula (II)

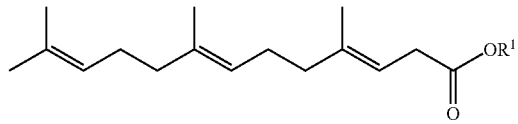
(II)

wherein $R^1$ is as defined above.

12. A method of preparing an unsaturated 3-(E)-carboxylic acid of the general formula (Ia):

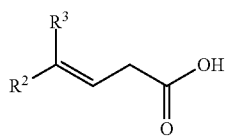
(Ia)

wherein
$R^2$ and $R^3$ are as defined above;
wherein
a) an isomer mixture, comprising the 3-(E)- and the 3-(Z)-isomer of said carboxylic acid of formula (Ia) is subjected to an enzymatic esterification reaction in the presence of an alkanol of the formula $R^1OH$, wherein $R^1$ is a straight chain or branched, saturated or unsaturated $C_1$-$C_{20}$-hydrocarbyl residue, preferably a straight chain or branched, saturated $C_1$-$C_{20}$ alkyl, preferably $C_1$-$C_4$ alkyl residue; and in the presence of a lipase enzyme as defined in one of the embodiments 1 to 6;
b) said 3-(E)-carboxylic ester as formed in step a) is isolated, for example by transferring the non-reacted acid isomer in an aqueous phase (as acid salt) and recovering the ester by means of an organic solvent which was either present during the conversion or which was added afterwards; and
c) said isolated ester of step b) is saponified to the corresponding 3-(E)-carboxylic acid of formula (Ia).

13. A method of preparing an unsaturated 3-(E)-carboxylic acid of the general formula (Ia):

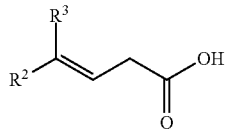
(Ia)

wherein
$R^2$ and $R^3$ are as defined above;
wherein
a) an isomer mixture, comprising the 3-(E)- and the 3-(Z)-isomer of a carboxylic acid ester of formula (Ib)

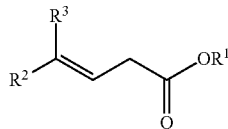
(Ib)

wherein

R¹ is a straight chain or branched, saturated or unsaturated $C_1$-$C_{20}$-hydrocarbyl residue, preferably a straight chain or branched, saturated $C_1$-$C_{20}$ alkyl, preferably $C_1$-$C_4$ alkyl, residue; and R² and R³ are as defined above;

is subjected to an enzymatic ester cleavage reaction in the presence of a lipase enzyme as defined in one of the embodiments 1 to 6, and preferably in the presence of water and optionally an organic solvent;

b) said 3-(E)-carboxylic acid as formed in step a) is isolated, preferably as free acid from the aqueous phase of the reaction mixture.

14. The method of embodiment 12 or 13, wherein an organic solvent as defined in one of the embodiments 9 and 10 is applied.

15. The method of one of the preceding embodiments, wherein said 3-(E)-isomer of an unsaturated carboxylic acid is 3-(E)/7-(E)-homofarnesoic acid.

16. The method of one of the preceding embodiments wherein said isomer mixture comprises a mixture of 3-(E)/7-(E)-homofarnesoic acid and 3-(Z)/7-(E)-homofarnesoic acid; or a mixture of 3-(E)/7-(E)-homofarnesoic acid ester and 3-(Z)/7-(E)-homofarnesoic acid ester of an alkanol of the formula R¹OH, wherein R¹ is a straight chain or branched, saturated or unsaturated $C_1$-$C_{20}$-hydrocarbyl residue.

17. The method of embodiment 16 for preparing 3-(E)/7-(E)-homofarnesoic acid wherein a) an isomer mixture, comprising 3-(E)/7-(E)-homofarnesoic acid and 3-(Z)/7-(E)-homofarnesoic acid is subjected to an enzymatic esterification reaction in the presence of an alkanol of the formula R¹OH, wherein R¹ is a straight chain or branched, saturated or unsaturated $C_1$-$C_{20}$-hydrocarbyl residue, preferably a straight chain or branched, saturated $C_1$-$C_{20}$ alkyl, preferably $C_1$-$C_4$ alkyl residue; and in the presence of a lipase enzyme as defined in one of the embodiments 1 to 6 in a solvent as defined in one of the embodiments 9 and 10;

b) said 3-(E)/7-(E)-homofarnesoic acid ester as formed in step a) is separated from unreacted acid (i.p. 3-(Z)/7-(E)-homofarnesoic acid), in particular by distillation or, preferably, extraction; and c) said isolated 3-(E)/7-(E)-homofarnesoic acid ester is saponified to 3-(E)/7-(E)-homofarnesoic acid.

18. The method of embodiment 16 for preparing 3-(E)/7-(E)-homofarnesoic acid wherein a) an isomer mixture, comprising 3-(E)/7-(E)-homofarnesoic acid ester and 3-(Z)/7-(E)-homofarnesoic acid ester is subjected to an enzymatic ester cleavage reaction in the presence of a lipase enzyme as defined in one of the embodiments 1 to 6 in a solvent as defined in one of the embodiments 9 and 10, and preferably in the presence of water; and b) said 3-(E)/7-(E)-homofarnesoic acid as formed in step a) is separated from unreacted ester (i.p. 3-(Z)/7-(E)-homofarnesoic acid ester), in particular by distillation or, preferably, extraction.

19. A method of preparing (−)-ambrox of the formula (III)

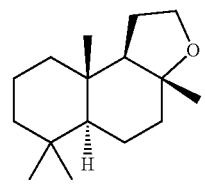

(III)

comprising the steps of a) obtaining said 3-(E)/7-(E)-homofarnesoic acid by applying a method as defined in any-one of the embodiments 1 to 18;

b) chemically reducing 3-(E)/7-(E)-homofarnesoic acid to 3-(E)/7-(E)-homofarnesol and c) enzymatically cycling of 3-(E)/7-(E)-homofarnesol to (−)-ambrox.

20. A method of preparing (−)-ambrox of the formula (III)

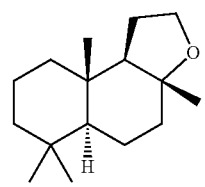

(III)

comprising the steps of a) obtaining said 3-(E)/7-(E)-homofarnesoic acid by applying a method as defined in any-one of the embodiments 1 to 18, b) enzymatically cycling of 3-(E)/7-(E)-homofarnesoic acid to sclareolide of the formula (IV)

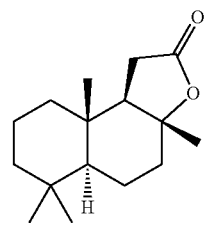

(IV)

and c) chemically converting said sclareolide to (−)-ambrox.

21. The method of embodiment 19 or 20, wherein the enzymatic cyclization is performed in the presence of an intramolecular transferase (E.C. 5.4), in particular a homofarnesoic acid cyclase (E.C. 5.4.99.17), in particular a squalene-hopene cyclase (E.C. 5.4.99.17), showing homofarnesoic acid cyclase activity.

22. The method of embodiment 21, wherein said cyclase is a natural or recombinantly produced, optionally genetically modified (mutated) squalene-hopene cyclase (SHC).

23. The method of embodiment 22, wherein said cyclase is a squalene hopene cyclase originating from *Methylococcus capsalatus, Rhodopseudomonas palustris, Bradyrhizobium japonicum, Frankia* spec., *Streptomyces coelicolor*, or, preferably, *Zymomonas mobilis*.

24. The method of embodiment 23, wherein said cyclase is from *Zymomonas mobilis*, comprising an amino acid sequence according to SEQ ID NO:2 or an amino acid sequence having at least 60% sequence identity to SEQ ID NO:2.

25. 3-(E)/7-(E)-homofarnesoic acid alkyl ester, wherein said alkyl group is selected from $C_2$-$C_{10}$, in particular $C_3$-$C_8$-alkyl, as for example, ethyl, n-propyl, isopropyl, n-butyl, 2-butyl, isobutyl or tert-buty; as well as pentyl, hexyl, heptyl, octyl, and their constitutional isomers; preferably in the form of the substantially stereoisomerically pure 3-(E)/7-(E)-form, and in particular as prepared according to a method as defined herein above.

In general cyclases applicable in said aspect of the invention are SHCs which are listed below by making reference to their wild type sequence (SEQ ID NO's and Genbank-numbers are stated) and their microbial source.

| S_ID DB | SEQ ID NO | Organism | GI-Nr. der Referenz Sequenzen |
|---|---|---|---|
| s1 | seq_ID 2 | *Zymomonas mobilis* | AAV90172.1 |
| s20 | seq_ID 3 | *Streptomyces coelicolor* | CAB39697.1 |
| s911 | seq_ID 4 | *Acetobacter pasteurianus* | BAH99456.1 |
| s2 | seq_ID 5 | *Bradyrhizobium* sp. | ABQ33590.1 |
| s940 | seq_ID 6 | *Zymomonas mobilis* | EER62728.1 |
| s949 | seq_ID 7 | *Acidithiobacillus caldus* | EET25937.1 |
| s167 | seq_ID 8 | *Acidithiobacillus ferrooxidans* | ACH84004.1 |
| s41 | seq_ID 9 | *Acidobacterium capsulatum* | ACO34244.1 |
| s36 | seq_ID 10 | *Acidothermus cellulolyticus* | ABK53469.1 |
| s83 | seq_ID 11 | *Adiantum capillus-veneris* | BAF93209.1 |
| s143 | seq_ID 12 | *Ajellomyces capsulatus* | EDN09769.1 |
| s995 | seq_ID 13 | *Ajellomyces capsulatus* | EER40510.1 |
| s163 | seq_ID 14 | *Ajellomyces capsulatus* | EEH02950.1 |
| s13 | seq_ID 15 | *Alicyclobacillus acidocaldarius* | EED08231.1 |
| s14 | seq_ID 16 | *Alicyclobacillus acidocaldarius* | P33247.4 |
| s1193 | seq_ID 17 | *Alicyclobacillus acidocaldarius* | AAT70690.1 |
| s21 | seq_ID 18 | *Alicyclobacillus acidoterrestris* | CAA61950.1 |
| s1189 | seq_ID 19 | *Alicyclobacillus acidoterrestris* | AAT70691.1 |
| s51 | seq_ID 20 | *Anabaena variabilis* | ABA24268.1 |
| s76 | seq_ID 21 | *Anaeromyxobacter* sp. | ABS28257.1 |
| s159 | seq_ID 22 | *Aspergillus clavatus* | EAW07713.1 |
| s131 | seq_ID 23 | *Aspergillus flavus* | EED48353.1 |
| s176 | seq_ID 24 | *Aspergillus fumigatus* | EDP50814.1 |
| s126 | seq_ID 25 | *Aspergillus fumigatus* | EAL84865.1 |
| s178 | seq_ID 26 | *Aspergillus fumigatus* | EAL86291.2 |
| s121 | seq_ID 27 | *Aspergillus niger* | CAK43501.1 |
| s115 | seq_ID 28 | *Aspergillus niger* | CAK45506.1 |
| s124 | seq_ID 29 | *Aspergillus oryzae* | BAE63941.1 |
| s119 | seq_ID 30 | *Azotobacter vinelandii* | EAM07611.1 |
| s223 | seq_ID 31 | *Bacillus amyloliquefaciens* | ABS74269.1 |
| s221 | seq_ID 32 | *Bacillus anthracis* | AAP27368.1 |
| s976 | seq_ID 33 | *Bacillus cereus* | EEK66523.1 |
| s225 | seq_ID 34 | *Bacillus cereus* | EAL12758.1 |
| s972 | seq_ID 35 | *Bacillus cereus* | EEL44583.1 |
| s977 | seq_ID 36 | *Bacillus cereus* | EEK43841.1 |
| s985 | seq_ID 37 | *Bacillus cereus* | EEK82938.1 |
| s988 | seq_ID 38 | *Bacillus cereus* | EEK99528.1 |
| s981 | seq_ID 39 | *Bacillus cereus* | EEK77935.1 |
| s987 | seq_ID 40 | *Bacillus cereus* | EEL81079.1 |
| s960 | seq_ID 41 | *Bacillus cereus* | EEK88307.1 |
| s979 | seq_ID 42 | *Bacillus cereus* | EEL63943.1 |
| s974 | seq_ID 43 | *Bacillus cereus* | EEL59884.1 |
| s956 | seq_ID 44 | *Bacillus cereus* | EEL69857.1 |
| s951 | seq_ID 45 | *Bacillus cereus* | EEL92663.1 |
| s986 | seq_ID 46 | *Bacillus cereus* | EEL49968.1 |
| s227 | seq_ID 47 | *Bacillus cereus* | AAU16998.1 |
| s224 | seq_ID 48 | *Bacillus cereus* | AAS42477.1 |
| s212 | seq_ID 49 | *Bacillus cereus* | ACK95843.1 |
| s289 | seq_ID 50 | *Bacillus coahuilensis* | 205373680 |
| s219 | seq_ID 51 | *Bacillus cytotoxicus* | ABS22481.1 |
| s230 | seq_ID 52 | *Bacillus licheniformis* | AAU23777.1 |
| s955 | seq_ID 53 | *Bacillus mycoides* | EEL98438.1 |
| s990 | seq_ID 54 | *Bacillus mycoides* | EEM04821.1 |
| s989 | seq_ID 55 | *Bacillus pseudomycoides* | EEM16144.1 |
| s247 | seq_ID 56 | *Bacillus pumilus* | ABV62529.1 |
| s250 | seq_ID 57 | *Bacillus pumilus* | EDW21137.1 |
| s249 | seq_ID 58 | *Bacillus* sp. | EAR64404.1 |
| s218 | seq_ID 59 | *Bacillus* sp. | EDL66148.1 |
| s241 | seq_ID 60 | *Bacillus subtilis* | Q796C3.1 |
| s284 | seq_ID 61 | *Bacillus subtilis* | AAB84441.1 |
| s215 | seq_ID 62 | *Bacillus thuringiensis* | ABK86448.1 |
| s984 | seq_ID 63 | *Bacillus thuringiensis* | EEM21409.1 |
| s957 | seq_ID 64 | *Bacillus thuringiensis* | EEM82653.1 |
| s980 | seq_ID 65 | *Bacillus thuringiensis* | EEM52372.1 |
| s961 | seq_ID 66 | *Bacillus thuringiensis* | EEM27851.1 |
| s969 | seq_ID 67 | *Bacillus thuringiensis* | EEM40716.1 |
| s959 | seq_ID 68 | *Bacillus thuringiensis* | EEM46814.1 |
| s965 | seq_ID 69 | *Bacillus thuringiensis* | EEM94969.1 |
| s202 | seq_ID 70 | *Bacillus weihenstephanensis* | ABY44436.1 |
| s63 | seq_ID 71 | Bacterium Ellin514 | EEF57225.1 |
| s72 | seq_ID 72 | Bacterium Ellin514 | EEF59508.1 |
| s87 | seq_ID 73 | *Beijerinckia indica* | ACB96717.1 |
| s69 | seq_ID 74 | *Blastopirellula marina* | EAQ81955.1 |
| s543 | seq_ID 75 | *Blastopirellula marina* | EAQ78122.1 |
| s156 | seq_ID 76 | *Bradyrhizobium japonicum* | CAA60250.1 |
| s938 | seq_ID 77 | *Acetobacter pasteurianus* | BAH98349.1 |
| s3 | seq_ID 78 | *Bradyrhizobium* sp. | CAL79893.1 |
| s201 | seq_ID 79 | *Brevibacillus brevis* | BAH44778.1 |
| s148 | seq_ID 80 | *Burkholderia ambifaria* | EDT05097.1 |
| s158 | seq_ID 81 | *Burkholderia ambifaria* | EDT37649.1 |
| s149 | seq_ID 82 | *Burkholderia ambifaria* | ACB68303.1 |
| s100 | seq_ID 83 | *Burkholderia ambifaria* | EDT42454.1 |
| s146 | seq_ID 84 | *Burkholderia cenocepacia* | EAY66961.1 |
| s139 | seq_ID 85 | *Burkholderia cenocepacia* | ACA95661.1 |
| s147 | seq_ID 86 | *Burkholderia cenocepacia* | CAR57099.1 |
| s95 | seq_ID 87 | *Burkholderia cenocepacia* | CAR56694.1 |
| s102 | seq_ID 88 | *Burkholderia dolosa* | EAY71311.1 |
| s941 | seq_ID 89 | *Burkholderia glumae* | ACR32572.1 |
| s945 | seq_ID 90 | *Burkholderia glumae* | ACR30752.1 |
| s132 | seq_ID 91 | *Burkholderia graminis* | EDT12320.1 |
| s104 | seq_ID 92 | *Burkholderia mallei* | ABM48844.1 |
| s140 | seq_ID 93 | *Burkholderia multivorans* | ABX19650.1 |
| s116 | seq_ID 94 | *Burkholderia multivorans* | ABX16859.1 |
| s91 | seq_ID 95 | *Burkholderia oklahomensis* | 167567074 |
| s111 | seq_ID 96 | *Burkhoderia phymatum* | ACC73258.1 |
| s127 | seq_ID 97 | *Burkholderia phytofirmans* | ACD21317.1 |
| s120 | seq_ID 98 | *Burkholderia pseudomallei* | EEC32728.1 |
| s137 | seq_ID 99 | *Burkholderia* sp. | EEA03553.1 |
| s144 | seq_ID 100 | *Burkholderia* sp. | ABB06563.1 |
| s98 | seq_ID 101 | *Burkholderia* sp. | ABB10136.1 |
| s944 | seq_ID 102 | *Burkholderia* sp. CCGE1002 | EFA54357.1 |
| s89 | seq_ID 103 | *Burkholderia thailandensis* | 167840988 |
| s113 | seq_ID 104 | *Burkholderia thailandensis* | 167617352 |
| s154 | seq_ID 105 | *Burkholderia ubonensis* | 167589807 |
| s93 | seq_ID 106 | *Burkholderia ubonensis* | 167584986 |
| s96 | seq_ID 107 | *Burkholderia vietnamiensis* | ABO56791.1 |
| s150 | seq_ID 108 | *Burkholderia xenovorans* | ABE35912.1 |
| s54 | seq_ID 109 | Candidates Koribacter | ABF40741.1 |
| s171 | seq_ID 110 | Candidates Kuenenia | CAJ71215.1 |
| s79 | seq_ID 111 | Candidates Solibacter | ABJ82180.1 |
| s99 | seq_ID 112 | Candidates Solibacter | ABJ82254.1 |
| s917 | seq_ID 113 | *Catenulispora acidiphila* | ACU75510.1 |
| s65 | seq_ID 114 | *Chthoniobacter flavus* | EDY15838.1 |
| s637 | seq_ID 115 | *Chthoniobacter flavus* | EDY22035.1 |
| s38 | seq_ID 116 | *Crocosphaera watsonii* | EAM53094.1 |
| s186 | seq_ID 117 | *Cupriavidus taiwanensis* | CAQ72562.1 |
| s32 | seq_ID 118 | *Cyanothece* sp. | ACB53858.1 |
| s40 | seq_ID 119 | *Cyanothece* sp. | ACK71719.1 |
| s30 | seq_ID 120 | *Cyanothece* sp. | EDY02410.1 |
| s29 | seq_ID 121 | *Cyanothece* sp. | ACK66841.1 |
| s47 | seq_ID 122 | *Cyanothece* sp. | EDX97382.1 |
| s35 | seq_ID 123 | *Cyanothece* sp. | EAZ91809.1 |
| s39 | seq_ID 124 | *Cyanothece* sp. | ACL45896.1 |
| s925 | seq_ID 125 | *Cyanothece* sp. PCC 8802 | ACV02092.1 |

| S_ID DB | SEQ ID NO | Organism | GI-Nr. der Referenz Sequenzen |
|---|---|---|---|
| s64 | seq_ID 126 | Desulfovibrio salexigens | EEC62384.1 |
| s74 | seq_ID 127 | Dryopteris crassirhizoma | BAG68223.1 |
| s59 | seq_ID 128 | Frankia alni | CAJ61140.1 |
| s48 | seq_ID 129 | Frankia alni | CAJ60090.1 |
| s56 | seq_ID 130 | Frankia sp. | ABD10207.1 |
| s60 | seq_ID 131 | Frankia sp. | ABW15063.1 |
| s31 | seq_ID 132 | Frankia sp. | ABW14125.1 |
| s948 | seq_ID 133 | Frankia sp. Eul1c | EFA59873.1 |
| s919 | seq_ID 134 | Frankia sp. Eul1c | EFA59089.1 |
| s628 | seq_ID 135 | Gemmata obscuriglobus | 168700710 |
| s209 | seq_ID 136 | Geobacillus sp. | EED61885.1 |
| s206 | seq_ID 137 | Geobacillus sp. | EDY05760.1 |
| s964 | seq_ID 138 | Geobacillus sp. Y412MC52 | EEN95021.1 |
| s993 | seq_ID 139 | Geobacillus sp. Y412MC61 | ACX79399.1 |
| s205 | seq_ID 140 | Geobacillus thermodenitrificans | ABO67242.1 |
| s15 | seq_ID 141 | Geobacter bemidjiensis | ACH40355.1 |
| s8 | seq_ID 142 | Geobacter lovleyi | ACD95949.1 |
| s62 | seq_ID 143 | Geobacter metallireducens | ABB30662.1 |
| s12 | seq_ID 144 | Geobacter metallireducens | ABB33038.1 |
| s73 | seq_ID 145 | Geobacter sp. | ACM21577.1 |
| s10 | seq_ID 146 | Geobacter sp. | EDV72707.1 |
| s11 | seq_ID 147 | Geobacter sp. | ACM22003.1 |
| s913 | seq_ID 148 | Geobacter sp. M18 | EET34621.1 |
| s914 | seq_ID 149 | Geobacter sp. M21 | ACT16952.1 |
| s58 | seq_ID 150 | Geobacter sulfurreducens | AAR36453.1 |
| s7 | seq_ID 151 | Geobacter sulfurreducens | AAR34018.1 |
| s9 | seq_ID 152 | Geobacter uraniireducens | ABQ25226.1 |
| s46 | seq_ID 153 | Cloeobacter violaceus | BAC91998.1 |
| s67 | seq_ID 154 | Gluconacetobacter diazotrophicus | ACI51585.1 |
| s165 | seq_ID 155 | Gluconacetobacter diazotrophicus | CAP55563.1 |
| s68 | seq_ID 156 | Gluconobacter oxydans | AAW61994.1 |
| s80 | seq_ID 157 | Granulibacter bethesdensis | ABI63005.1 |
| s937 | seq_ID 158 | Hyphomicrobium denitrificans | EET65847.1 |
| s932 | seq_ID 159 | Leptospirillum ferrodiazotrophum | EES53667.1 |
| s24 | seq_ID 160 | Leptospirillum rubarum | EAY57382.1 |
| s25 | seq_ID 161 | Leptospirillum sp. | EDZ38599.1 |
| s174 | seq_ID 162 | Magnaporthe grisea | EDK02551.1 |
| s153 | seq_ID 163 | Magnetospirillum magnetotacticum | 46203107 |
| s49 | seq_ID 164 | Methylacidiphilum infernorum | ACD82457.1 |
| s169 | seq_ID 165 | Methylobacterium chloromethanicum | ACK83067.1 |
| s75 | seq_ID 166 | Methylobacterium chloromethanicum | ACK86232.1 |
| s946 | seq_ID 167 | Methylobacterium extorquens | CAX24364.1 |
| s141 | seq_ID 168 | Methylobacterium nodulans | ACL61886.1 |
| s152 | seq_ID 169 | Methylobacterium populi | ACB79998.1 |
| s162 | seq_ID 170 | Methylobacterium radiotolerans | ACB27373.1 |
| s180 | seq_ID 171 | Methylobacterium sp. | ACA20611.1 |
| s175 | seq_ID 172 | Methylocella silvestris | ACK52150.1 |
| s181 | seq_ID 173 | Methylococcus capsulatus | CAA71098.1 |
| s55 | seq_ID 174 | Microcystis aeruginosa | CAO86472.1 |
| s101 | seq_ID 175 | Neosartorya fischeri | EAW20752.1 |
| s129 | seq_ID 176 | Nitrobacter hamburgensis | ABE63461.1 |
| s161 | seq_ID 177 | Nitrobacter sp. | EAQ34404.1 |
| s160 | seq_ID 178 | Nitrobacter winogradskyi | ABA05523.1 |
| s157 | seq_ID 179 | Nitrococcus mobilis | EAR22397.1 |
| s164 | seq_ID 180 | Nitrosococcus oceani | ABA57818.1 |
| s170 | seq_ID 181 | Nitrosomonas europaea | CAD85079.1 |
| s173 | seq_ID 182 | Nitrosomonas eutropha | ABI59752.I |
| s943 | seq_ID 183 | Nitrosomonas sp. AL212 | EET32702.1 |
| s142 | seq_ID 184 | Nitrosospira multiformis | ABB75845.1 |
| s52 | seq_ID 185 | Nostoc punctiforme | ACC84529.1 |
| s45 | seq_ID 186 | Nostoc sp. | BAB72732.1 |
| s122 | seq_ID 187 | Oligotropha carboxidovorans | ACI93782.1 |
| s233 | seq_ID 188 | Paenibacillus sp. | EDS49994.1 |
| s991 | seq_ID 189 | Paenibacillus sp. JDR-2 | ACS99948.1 |
| s950 | seq_ID 190 | Paenibacillus sp. oral taxon 786 | EES74793.1 |
| s1280 | seq_ID 191 | Paramecium tetraurelia | 145542269 |
| s71 | seq_ID 192 | Pelobacter carbinolicus | ABA87701.1 |
| s5 | seq_ID 193 | Pelobacter carbinolicus | ABA87615.1 |
| s66 | seq_ID 194 | Pelobacter propionicus | ABK98395.1 |
| s16 | seq_ID 195 | Pelobacter propionicus | ABK98811.1 |
| s136 | seq_ID 196 | Penicillium chrysogenum | CAP99707.1 |
| s936 | seq_ID 197 | Planctomyces limnophilus | EEO67214.1 |
| s1158 | seq_ID 198 | Planctomyces limnophilus | EEO68341.1 |
| s526 | seq_ID 199 | Planctomyces maris | EDL58855.1 |
| s992 | seq_ID 200 | Polypodiodes niponica | BAI48071.1 |
| s942 | seq_ID 201 | Polypodiodes niponica | BAI48070.1 |
| s1202 | seq_ID 202 | Populus trichocarpa | EEF12098.1 |
| s168 | seq_ID 203 | Ralstonia eutropha | AAZ64302.1 |
| s190 | seq_ID 204 | Ralstonia eutropha | CAJ96989.1 |
| s81 | seq_ID 205 | Ralstonia metallidurans | ABF11015.1 |
| s110 | seq_ID 206 | Ralstonia metallidurans | ABF11268.1 |
| s123 | seq_ID 207 | Rhizobium sp. | P55348.1 |
| s657 | seq_ID 208 | Rhodopirellula baltica | CAD74517.1 |
| s4 | seq_ID 209 | Rhodopseudomonas palustris | ABJ08391.1 |
| s130 | seq_ID 210 | Rhodopseudomonas palustris | CAA71101 1 |
| s155 | seq_ID 211 | Rhodopseudomonas palustris | ABD06434.1 |
| s97 | seq_ID 212 | Rhodopseudomonas palustris | ABD87279.1 |
| s135 | seq_ID 213 | Rhodopseudomonas palustris | ACF02757.1 |
| s84 | seq_ID 214 | Rhodospirillum rubrum | ABC20867.1 |
| s1279 | seq_ID 215 | Rubrobacter xylanophilus | ABG05671.1 |
| s915 | seq_ID 216 | Saccharomonospora viridis | ACU97316.1 |
| s42 | seq_ID 217 | Saccharopolyspora erythraea | CAM03596.1 |
| s82 | seq_ID 218 | Schizosaccharomyces japonicus | EEB08219.1 |
| s923 | seq_ID 219 | Sphaerobacter thermophilus | ACZ39437.1 |
| s924 | seq_ID 220 | Streptomyces albus | 239983547 |
| s23 | seq_ID 221 | Streptomyces avermitilis | BAC69361.1 |
| s44 | seq_ID 222 | Acaryochloris marina | ABW29816.1 |
| s921 | seq_ID 223 | Streptomyces filamentosus | 239945642 |
| s934 | seq_ID 224 | Streptomyces flavogriseus | EEW70811.1 |
| s920 | seq_ID 225 | Streptomyces ghanaensis | 239927462 |
| s922 | seq_ID 226 | Streptomyces griseoflavus | 256812310 |
| s28 | seq_ID 227 | Streptomyces griseus | BAG17791.1 |
| s926 | seq_ID 228 | Streptomyces hygroscopicus | 256775136 |
| s916 | seq_ID 229 | Streptomyces lividans | 256783789 |
| s33 | seq_ID 230 | Streptomyces peucetius | ACA52082.1 |
| s27 | seq_ID 231 | Streptomyces pristinaespiralis | EDY61772.1 |
| s933 | seq_ID 232 | Streptomyces scabiei | CBG68454.1 |
| s37 | seq_ID 233 | Streptomyces sp. | EDX25760.1 |
| s34 | seq_ID 234 | Streptomyces sp. | EDY46371.1 |
| s931 | seq_ID 235 | Streptomyces sp. AA4 | 256668250 |
| s918 | seq_ID 236 | Streptomyces sp. C | 256770952 |
| s929 | seq_ID 237 | Streptomyces sp. Mg1 | 254385931 |
| s928 | seq_ID 238 | Streptomyces sp. SPB74 | 254379682 |
| s930 | seq_ID 239 | Streptomyces sp. SPB78 | 256680470 |
| s26 | seq_ID 240 | Streptomyces sviceus | EDY55942.1 |
| s927 | seq_ID 241 | Streptomyces viridochromogenes | 256805984 |
| s61 | seq_ID 242 | Synechococcus sp. | EDX84551.1 |
| s935 | seq_ID 243 | Synechococcus sp. PCC 7335 | 254422098 |
| s53 | seq_ID 244 | Synechocystis sp. | BAA17978.1 |
| s22 | seq_ID 245 | Syntrophobacter fumaroxidans | ABK18414.1 |
| s6 | seq_ID 246 | Syntrophobacter fumaroxidans | ABK17672.1 |
| s912 | seq_ID 247 | Teredinibacter turnerae | ACR13362.1 |
| s57 | seq_ID 248 | Thermosynechococcus elongatus | BAC09861.1 |
| s43 | seq_ID 249 | Trichodesmium erythraeum | ABG50159.1 |
| s1178 | seq_ID 250 | Uncultured organism | ACA58560.1 |
| s1176 | seq_ID 251 | Uncultured organism | ABL07557.1 |
| s1165 | seq_ID 252 | Uncultured organism | ACA58559.1 |
| s1166 | seq_ID 253 | Uncultured organism | ACA58558.1 |
| s1168 | seq_ID 254 | Uncultured organism | ABL07560.1 |
| s1169 | seq_ID 255 | Uncultured organism | ABL07565.1 |
| s1170 | seq_ID 256 | Uncultured organism | ABL07566.1 |
| s1167 | seq_ID 257 | Uncultured organism | ACA58545.1 |
| s1171 | seq_ID 258 | Uncultured organism | ACA58535.1 |
| s1180 | seq_ID 259 | Uncultured organism | ACA58549.1 |

-continued

| S_ID DB | SEQ ID NO | Organism | GI-Nr. der Referenz Sequenzen |
|---|---|---|---|
| s1179 | seq_ID 260 | Uncultured organism | ACA58554.1 |
| s1181 | seq_ID 261 | Uncultured organism | ACA58555.1 |
| s1182 | seq_ID 262 | Uncultured organism | ACA58556.1 |
| s1235 | seq_ID 263 | Uncultured organism | ACA58530.1 |
| s1188 | seq_ID 264 | Uncultured organism | ACA58534.1 |
| s1237 | seq_ID 265 | Uncultured organism | ACA58552.1 |
| s1223 | seq_ID 266 | Uncultured organism | ABL07558.1 |
| s1200 | seq_ID 267 | Uncultured organism | ABL07542.1 |
| s1236 | seq_ID 268 | Uncultured organism | ACA58539.1 |
| s1238 | seq_ID 269 | Uncultured organism | ACA58537.1 |
| s1233 | seq_ID 270 | Uncultured organism | ACA58543.1 |
| s1173 | seq_ID 271 | Uncultured organism | ABL07553.1 |
| s1241 | seq_ID 272 | Uncultured organism | ABL07540.1 |
| s1242 | seq_ID 273 | Uncultured organism | ABL07544.1 |
| s1225 | seq_ID 274 | Uncultured organism | ACA58557.1 |
| s1183 | seq_ID 275 | Uncultured organism | ACA58520.1 |
| s1197 | seq_ID 276 | Uncultured organism | ACA58524.1 |
| s1185 | seq_ID 277 | Uncultured organism | ACA58522.1 |
| s1190 | seq_ID 278 | Uncultured organism | ACA58525.1 |
| s1187 | seq_ID 279 | Uncultured organism | ACA58523.1 |
| s1184 | seq_ID 280 | Uncultured organism | ACA58521.1 |
| s1204 | seq_ID 281 | Uncultured organism | ACA58547.1 |
| s1221 | seq_ID 282 | Uncultured organism | ACA58544.1 |
| s1198 | seq_ID 283 | Uncultured organism | ACA58546.1 |
| s1226 | seq_ID 284 | Uncultured organism | ACA58527.1 |
| s1227 | seq_ID 285 | Uncultured organism | ABL07537.1 |
| s1232 | seq_ID 286 | Uncultured organism | ACA58510.1 |
| s1230 | seq_ID 287 | Uncultured organism | ACA58538.1 |
| s1229 | seq_ID 288 | Uncultured organism | ACA68642.1 |
| s1231 | seq_ID 289 | Uncultured organism | ACA58540.1 |
| s1207 | seq_ID 290 | Uncultured organism | ABL07564.1 |
| s1212 | seq_ID 291 | Uncultured organism | ABL07563.1 |
| s1208 | seq_ID 292 | Uncultured organism | ABL07562.1 |
| s1209 | seq_ID 293 | Uncultured organism | ABL07559.1 |
| s1214 | seq_ID 294 | Uncultured organism | ABL07556.1 |
| s1216 | seq_ID 295 | Uncultured organism | ACA58528.1 |
| s1219 | seq_ID 296 | Uncultured organism | ACA58536.1 |
| s1192 | seq_ID 297 | Uncultured organism | ABL07533.1 |
| s1195 | seq_ID 298 | Uncultured organism | ABL07536.1 |
| s1174 | seq_ID 299 | Uncultured organism | ABL07545.1 |
| s1186 | seq_ID 300 | Uncultured organism | ABL07548.1 |
| s1196 | seq_ID 301 | Uncultured organism | ACA58561.1 |
| s1172 | seq_ID 302 | Uncultured organism | ABL07555.1 |
| s1194 | seq_ID 303 | Uncultured organism | ABL07541.1 |
| s1211 | seq_ID 304 | Uncultured organism | ABL07554.1 |
| s1220 | seq_ID 305 | Uncultured organism | ABL07547.1 |
| s1203 | seq_ID 306 | Uncultured organism | ABL07550.1 |
| s1199 | seq_ID 307 | Uncultured organism | ABL07551.1 |
| s1228 | seq_ID 308 | Uncultured organism | ACA58509.1 |
| s1201 | seq_ID 309 | Uncultured organism | ACA58514.1 |
| s1205 | seq_ID 310 | Uncultured organism | ABL07543.1 |
| s1206 | seq_ID 311 | Uncultured organism | ABL07534.1 |
| s1177 | seq_ID 312 | Uncultured organism | ABL07546.1 |
| s1210 | seq_ID 313 | Uncultured organism | ABL07535.1 |
| s1175 | seq_ID 314 | Uncultured organism | ABL07552.1 |
| s1191 | seq_ID 315 | Uncultured organism | ABL07549.1 |
| s1222 | seq_ID 316 | Uncultured organism | ACA58553.1 |
| s1244 | seq_ID 317 | Uncultured organism | ABL07539.1 |
| s1213 | seq_ID 318 | Uncultured organism | ACA58532.1 |
| s1239 | seq_ID 319 | Uncultured organism | ACA58548.1 |
| s1215 | seq_ID 320 | Uncultured organism | ABL07561.1 |
| s1240 | seq_ID 321 | Uncultured organism | ACA58533.1 |
| s1234 | seq_ID 322 | Uncultured organism | ABL07538.1 |
| s1224 | seq_ID 323 | Uncultured organism | ACA58541.1 |
| s1217 | seq_ID 324 | Uncultured organism | ACA58529.1 |
| s596 | seq_ID 325 | *Verrucomicrobium spinosum* | 171910093 |
| s70 | seq_ID 326 | *Acidiphilium cryplum* | ABQ30890.1 |

SEQ ID NO:2 is the amino acid sequence of a cyclase which is also known as Zm-SHC-1.

3. Enzymes and Enzyme Mutants According to the Invention

The present invention is not limited to the use of the specifically disclosed lipases and cyclases, but also extends to functional equivalents thereof.

"Functional equivalents" or analogs of the concretely disclosed enzymes are, within the scope of the present invention, various polypeptides thereof, which moreover possess the desired biological function or activity, e.g. enzyme activity.

For example, "functional equivalents" means enzymes, which, in a test used for enzymatic activity, display at least a 1 to 10%, or at least 20%, or at least 50%, or at least 75%, or at least 90% higher or lower activity of an enzyme, as defined herein.

"Functional equivalents", according to the invention, also means in particular mutants, which, in at least one sequence position of the amino acid sequences stated above, have an amino acid that is different from that concretely stated, but nevertheless possess one of the aforementioned biological activities. "Functional equivalents" thus comprise the mutants obtainable by one or more, as for example 1, 2, 3, 4, 5, 6, 7, 8, 9, 10, 11, 12, 13, 14, or 15, amino acid additions, substitutions, insertions, deletions and/or inversions, where the stated changes can occur in any sequence position, provided they lead to a mutant with the profile of properties according to the invention. Functional equivalence is in particular also provided if the reactivity patterns coincide qualitatively between the mutant and the unchanged polypeptide, i.e. if for example the same substrates are converted at a different rate. Examples of suitable amino acid substitutions are shown in the following table:

| Original residue | Examples of the substitution |
|---|---|
| Ala | Ser |
| Arg | Lys |
| Asn | Gln; His |
| Asp | Glu |
| Cys | Ser |
| Gln | Asn |
| Glu | Asp |
| Gly | Pro |
| His | Asn; Gln |
| Ile | Leu; Val |
| Leu | Ile; Val |
| Lys | Arg; Gln; Glu |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

"Functional equivalents" in the above sense are also "precursors" of the polypeptides described, as well as "functional derivatives" and "salts" of the polypeptides.

"Precursors" are in that case natural or synthetic precursors of the polypeptides with or without the desired biological activity.

The expression "salts" means salts of carboxyl groups as well as salts of acid addition of amino groups of the protein molecules according to the invention. Salts of carboxyl groups can be produced in a known way and comprise inorganic salts, for example sodium, calcium, ammonium, iron and zinc salts, and salts with organic bases, for example amines, such as triethanolamine, arginine, lysine, piperidine and the like. Salts of acid addition, for example salts with inorganic acids, such as hydrochloric acid or sulfuric acid and salts with organic acids, such as acetic acid and oxalic acid, are also covered by the invention.

"Functional derivatives" of polypeptides according to the invention can also be produced on functional amino acid side groups or at their N-terminal or C-terminal end using known techniques. Such derivatives comprise for example aliphatic esters of carboxylic acid groups, amides of carboxylic acid groups, obtainable by reaction with ammonia or with a primary or secondary amine; N-acyl derivatives of free amino groups, produced by reaction with acyl groups; or O-acyl derivatives of free hydroxy groups, produced by reaction with acyl groups.

"Functional equivalents" naturally also comprise polypeptides that can be obtained from other organisms, as well as naturally occurring variants. For example, areas of homologous sequence regions can be established by sequence comparison, and equivalent enzymes can be determined on the basis of the concrete parameters of the invention.

"Functional equivalents" also comprise fragments, preferably individual domains or sequence motifs, of the polypeptides according to the invention, which for example display the desired biological function.

"Functional equivalents" are, moreover, fusion proteins, which have one of the polypeptide sequences stated above or functional equivalents derived there from and at least one further, functionally different, heterologous sequence in functional N-terminal or C-terminal association (i.e. without substantial mutual functional impairment of the fusion protein parts). Non-limiting examples of these heterologous sequences are e.g. signal peptides, histidine anchors or enzymes.

"Functional equivalents" that are also included according to the invention are homologues of the concretely disclosed proteins. These possess percent identity values as stated above. Said values refer to the identity with the concretely disclosed amino acid sequences, and may be calculated according to the algorithm of Pearson and Lipman, Proc. Natl. Acad, Sci. (USA) 85(8), 1988, 2444-2448.

The % identity values may also be calculated from BLAST alignments, algorithm blastp (protein-protein BLAST) or by applying the Clustal setting as given below.

A percentage identity of a homologous polypeptide according to the invention means in particular the percentage identity of the amino acid residues relative to the total length of one of the amino acid sequences concretely described herein.

In the case of a possible protein glycosylation, "functional equivalents" according to the invention comprise proteins of the type designated above in deglycosylated or glycosylated form as well as modified forms that can be obtained by altering the glycosylation pattern.

Such functional equivalents or homologues of the proteins or polypeptides according to the invention can be produced by mutagenesis, e.g. by point mutation, lengthening or shortening of the protein.

Such functional equivalents or homologues of the proteins according to the invention can be identified by screening combinatorial databases of mutants, for example shortening mutants. For example, a variegated database of protein variants can be produced by combinatorial mutagenesis at the nucleic acid level, e.g. by enzymatic ligation of a mixture of synthetic oligonucleotides. There are a great many methods that can be used for the production of databases of potential homologues from a degenerated oligonucleotide sequence. Chemical synthesis of a degenerated gene sequence can be carried out in an automatic DNA synthesizer, and the synthetic gene can then be ligated in a suitable expression vector. The use of a degenerated genome makes it possible to supply all sequences in a mixture, which code for the desired set of potential protein sequences. Methods of synthesis of degenerated oligonucleotides are known to a person skilled in the art (e.g. Narang, S. A. (1983) Tetrahedron 39:3; Itakura et al. (1984) Annu. Rev. Biochem. 53:323; Itakura et al., (1984) Science 198:1056; Ike et al. (1983) Nucleic Acids Res. 11:477).

In the prior art, several techniques are known for the screening of gene products of combinatorial databases, which were produced by point mutations or shortening, and for the screening of cDNA libraries for gene products with a selected property. These techniques can be adapted for the rapid screening of the gene banks that were produced by combinatorial mutagenesis of homologues according to the invention. The techniques most frequently used for the screening of large gene banks, which are based on a high-throughput analysis, comprise cloning of the gene bank in expression vectors that can be replicated, transformation of the suitable cells with the resultant vector database and expression of the combinatorial genes in conditions in which detection of the desired activity facilitates isolation of the vector that codes for the gene whose product was detected. Recursive Ensemble Mutagenesis (REM), a technique that increases the frequency of functional mutants in the databases, can be used in combination with the screening tests, in order to identify homologues (Arkin and Yourvan (1992) PNAS 89:7811-7815; Delgrave et al. (1993) Protein Engineering 6(3):327-331).

4. Coding Nucleic Acid Sequences

The invention also relates to nucleic acid sequences that code for enzymes and mutants as defined herein.

The present invention also relates to nucleic acids with a certain degree of "identity" to the sequences specifically disclosed herein. "Identity" between two nucleic acids means identity of the nucleotides, in each case over the entire length of the nucleic acid.

For example the identity may be calculated by means of the Vector NTI Suite 7.1 program of the company Informax (USA) employing the Clustal Method (Higgins D G, Sharp P M. Fast and sensitive multiple sequence alignments on a microcomputer. Comput Appl. Biosci. 1989 April; 5(2):151-1) with the following settings:

Multiple Alignment Parameter:

| | |
|---|---|
| Gap opening penalty | 10 |
| Gap extension penalty | 10 |
| Gap separation penalty range | 8 |
| Gap separation penalty | off |
| % identity for alignment delay | 40 |
| Residue specific gaps | off |
| Hydrophilic residue gap | off |
| Transition weighting | 0 |

Pairwise Alignment Parameter:

| | |
|---|---|
| FAST algorithm | on |
| K-tuple size | 1 |
| Gap penalty | 3 |

| Window size | 5 |
| --- | --- |
| Number of best diagonals | 5 |

Alternatively the identity may be determined according to Chenna, Ramu, Sugawara, Hideaki, Koike, Tadashi, Lopez, Rodrigo, Gibson, Toby J, Higgins, Desmond G, Thompson, Julie D. Multiple sequence alignment with the Clustal series of programs. (2003) Nucleic Acids Res 31 (13):3497-500, the web page: www.ebi.ac.uk/Tools/clustalw/index.html # and the following settings

| DNA Gap Open Penalty | 15.0 |
| --- | --- |
| DNA Gap Extension Penalty | 6.66 |
| DNA Matrix | Identity |
| Protein Gap Open Penalty | 10.0 |
| Protein Gap Extension Penalty | 0.2 |
| Protein matrix | Gonnet |
| Protein/DNA ENDGAP | −1 |
| Protein/DNA GAPDIST | 4 |

All the nucleic acid sequences mentioned herein (single-stranded and double-stranded DNA and RNA sequences, for example cDNA and mRNA) can be produced in a known way by chemical synthesis from the nucleotide building blocks, e.g. by fragment condensation of individual overlapping, complementary nucleic acid building blocks of the double helix. Chemical synthesis of oligonucleotides can, for example, be performed in a known way, by the phosphoamidite method (Voet, Voet, 2nd edition, Wiley Press, New York, pages 896-897). The accumulation of synthetic oligonucleotides and filling of gaps by means of the Klenow fragment of DNA polymerase and ligation reactions as well as general cloning techniques are described in Sambrook et al. (1989), see below.

The invention also relates to nucleic acid sequences (single-stranded and double-stranded DNA and RNA sequences, e.g. cDNA and mRNA), coding for one of the above polypeptides and their functional equivalents, which can be obtained for example using artificial nucleotide analogs.

The invention relates both to isolated nucleic acid molecules, which code for polypeptides or proteins according to the invention or biologically active segments thereof, and to nucleic acid fragments, which can be used for example as hybridization probes or primers for identifying or amplifying coding nucleic acids according to the invention.

The nucleic acid molecules according to the invention can in addition contain non-translated sequences from the 3' and/or 5' end of the coding genetic region.

The invention further relates to the nucleic acid molecules that are complementary to the concretely described nucleotide sequences or a segment thereof.

The nucleotide sequences according to the invention make possible the production of probes and primers that can be used for the identification and/or cloning of homologous sequences in other cellular types and organisms. Such probes or primers generally comprise a nucleotide sequence region which hybridizes under "stringent" conditions (see below) on at least about 12, preferably at least about 25, for example about 40, 50 or 75 successive nucleotides of a sense strand of a nucleic acid sequence according to the invention or of a corresponding antisense strand.

An "isolated" nucleic acid molecule is separated from other nucleic acid molecules that are present in the natural source of the nucleic acid and can moreover be substantially free from other cellular material or culture medium, if it is being produced by recombinant techniques, or can be free from chemical precursors or other chemicals, if it is being synthesized chemically.

A nucleic acid molecule according to the invention can be isolated by means of standard techniques of molecular biology and the sequence information supplied according to the invention. For example, cDNA can be isolated from a suitable cDNA library, using one of the concretely disclosed complete sequences or a segment thereof as hybridization probe and standard hybridization techniques (as described for example in Sambrook, J., Fritsch, E. F. and Maniatis, T. Molecular Cloning: A Laboratory Manual. 2nd edition, Cold Spring Harbor Laboratory, Cold Spring Harbor Laboratory Press, Cold Spring Harbor, N.Y., 1989). In addition, a nucleic acid molecule comprising one of the disclosed sequences or a segment thereof, can be isolated by the polymerase chain reaction, using the oligonucleotide primers that were constructed on the basis of this sequence. The nucleic acid amplified in this way can be cloned in a suitable vector and can be characterized by DNA sequencing. The oligonucleotides according to the invention can also be produced by standard methods of synthesis, e.g. using an automatic DNA synthesizer.

Nucleic acid sequences according to the invention or derivatives thereof, homologues or parts of these sequences, can for example be isolated by usual hybridization techniques or the PCR technique from other bacteria, e.g. via genomic or cDNA libraries. These DNA sequences hybridize in standard conditions with the sequences according to the invention.

"Hybridize" means the ability of a polynucleotide or oligonucleotide to bind to an almost complementary sequence in standard conditions, whereas nonspecific binding does not occur between non-complementary partners in these conditions. For this, the sequences can be 90-100% complementary. The property of complementary sequences of being able to bind specifically to one another is utilized for example in Northern Blotting or Southern Blotting or in primer binding in PCR or RT-PCR.

Short oligonucleotides of the conserved regions are used advantageously for hybridization. However, it is also possible to use longer fragments of the nucleic acids according to the invention or the complete sequences for the hybridization. These standard conditions vary depending on the nucleic acid used (oligonucleotide, longer fragment or complete sequence) or depending on which type of nucleic acid—DNA or RNA—is used for hybridization. For example, the melting temperatures for DNA:DNA hybrids are approx. 10° C. lower than those of DNA:RNA hybrids of the same length.

For example, depending on the particular nucleic acid, standard conditions mean temperatures between 42 and 58° C. in an aqueous buffer solution with a concentration between 0.1 to 5×SSC (1×SSC=0.15 M NaCl, 15 mM sodium citrate, pH 7.2) or additionally in the presence of 50% formamide, for example 42° C. in 5×SSC, 50% formamide. Advantageously, the hybridization conditions for DNA:DNA hybrids are 0.1×SSC and temperatures between about 20° C. to 45° C., preferably between about 30° C. to 45° C. For DNA:RNA hybrids the hybridization conditions are advantageously 0.1×SSC and temperatures between about 30° C. to 55° C., preferably between about 45° C. to 55° C. These stated temperatures for hybridization are examples of calculated melting temperature values for a nucleic acid with a length of approx. 100 nucleotides and a G+C content of 50% in the absence of formamide. The experimental conditions for DNA hybridization are described in relevant genetics textbooks, for example Sambrook et al., 1989, and can be calculated using formulae that are known by a person skilled in the art, for example depending on the length of the nucleic acids, the type of hybrids or the G+C content. A person skilled in the art can obtain further information on hybridization from the following textbooks: Ausubel et al. (eds), 1985, Current Protocols in Molecular Biology, John Wiley & Sons, New York; Hames and Higgins (eds), 1985, Nucleic Acids Hybridization: A Practical Approach, IRL Press at Oxford University Press, Oxford; Brown (ed), 1991, Essential Molecular Biology: A Practical Approach, IRL Press at Oxford University Press, Oxford.

"Hybridization" can in particular be carried out under stringent conditions. Such hybridization conditions are for example described in Sambrook, J., Fritsch, E. F., Maniatis, T., in: Molecular Cloning (A Laboratory Manual), 2nd edition, Cold Spring Harbor Laboratory Press, 1989, pages 9.31-9.57 or in Current Protocols in Molecular Biology, John Wiley & Sons, N.Y. (1989), 6.3.1-6.3.6.

"Stringent" hybridization conditions mean in particular: Incubation at 42° C. overnight in a solution consisting of 50% formamide, 5×SSC (750 mM NaCl, 75 mM tri-sodium citrate), 50 mM sodium phosphate (pH 7.6), 5×Denhardt Solution, 10% dextran sulfate and 20 g/ml denatured, sheared salmon sperm DNA, followed by washing of the filters with 0.1×SSC at 65° C.

The invention also relates to derivatives of the concretely disclosed or derivable nucleic acid sequences.

Thus, further nucleic acid sequences according to the invention can be derived from the sequences specifically disclosed herein and can differ from it by addition, substitution, insertion or deletion of individual or several nucleotides, and furthermore code for polypeptides with the desired profile of properties.

The invention also encompasses nucleic acid sequences that comprise so-called silent mutations or have been altered, in comparison with a concretely stated sequence, according to the codon usage of a special original or host organism, as well as naturally occurring variants, e.g. splicing variants or allelic variants, thereof.

It also relates to sequences that can be obtained by conservative nucleotide substitutions (i.e. the amino acid in question is replaced by an amino acid of the same charge, size, polarity and/or solubility).

The invention also relates to the molecules derived from the concretely disclosed nucleic acids by sequence polymorphisms. These genetic polymorphisms can exist between individuals within a population owing to natural variation. These natural variations usually produce a variance of 1 to 5% in the nucleotide sequence of a gene.

Derivatives of nucleic acid sequences according to the invention mean for example allelic variants, having at least 60% homology at the level of the derived amino acid, preferably at least 80% homology, quite especially preferably at least 90% homology over the entire sequence range (regarding homology at the amino acid level, reference should be made to the details given above for the polypeptides). Advantageously, the homologies can be higher over partial regions of the sequences.

Furthermore, derivatives are also to be understood to be homologues of the nucleic acid sequences according to the invention, for example animal, plant, fungal or bacterial homologues, shortened sequences, single-stranded DNA or RNA of the coding and noncoding DNA sequence. For example, homologues have, at the DNA level, a homology of at least 40%, preferably of at least 60%, especially preferably of at least 70%, quite especially preferably of at least 80% over the entire DNA region given in a sequence specifically disclosed herein.

Moreover, derivatives are to be understood to be, for example, fusions with promoters. The promoters that are added to the stated nucleotide sequences can be modified by at least one nucleotide exchange, at least one insertion, inversion and/or deletion, though without impairing the functionality or efficacy of the promoters. Moreover, the efficacy of the promoters can be increased by altering their sequence or can be exchanged completely with more effective promoters even of organisms of a different genus.

5. Constructs According to the Invention

The invention also relates to expression constructs, containing, under the genetic control of regulatory nucleotide sequences, a nucleotide sequence coding for a polypeptide or fusion protein according to the invention; as well as vectors comprising at least one of these expression constructs.

"Expression unit" means, according to the invention, a nucleic acid with expression activity, which comprises a promoter as defined herein and, after functional association with a nucleic acid that is to be expressed or a gene, regulates the expression, i.e. the transcription and the translation of this nucleic acid or of this gene. In this context, therefore, it is also called a "regulatory nucleic acid sequence". In addition to the promoter, other regulatory elements may be present, e.g. enhancers.

"Expression cassette" or "expression construct" means, according to the invention, an expression unit, which is functionally associated with the nucleic acid that is to be expressed or the gene that is to be expressed. In contrast to an expression unit, an expression cassette thus comprises not only nucleic acid sequences, which regulate transcription and translation, but also the nucleic acid sequences, which should be expressed as protein as a result of the transcription and translation.

The terms "expression" or "overexpression" describe, in the context of the invention, the production or increase of intracellular activity of one or more enzymes in a microorganism, which are encoded by the corresponding DNA. For this, it is possible for example to insert a gene in an organism, replace an existing gene by another gene, increase the number of copies of the gene or genes, use a strong promoter or use a gene that codes for a corresponding enzyme with a high activity, and optionally these measures can be combined.

Preferably such constructs according to the invention comprise a promoter 5'-upstream from the respective coding sequence, and a terminator sequence 3'-downstream, and optionally further usual regulatory elements, in each case functionally associated with the coding sequence.

A "promoter", a "nucleic acid with promoter activity" or a "promoter sequence" mean, according to the invention, a nucleic acid that, functionally associated with a nucleic acid that is to be transcribed, regulates the transcription of this nucleic acid.

"Functional" or "operative" association means, in this context, for example the sequential arrangement of one of the nucleic acids with promoter activity and of a nucleic acid sequence that is to be transcribed and optionally further regulatory elements, for example nucleic acid sequences that enable the transcription of nucleic acids, and for example a terminator, in such a way that each of the regulatory elements can fulfill its function in the transcription of the nucleic acid sequence. This does not necessarily require a direct association in the chemical sense. Genetic control sequences, such as enhancer sequences, can also exert their function on the target sequence from more remote positions or even from other DNA molecules. Arrangements are preferred in which the nucleic acid sequence that is to be transcribed is positioned behind (i.e. at the 3' end) the promoter sequence, so that the two sequences are bound covalently to one another. The distance between the promoter sequence and the nucleic acid sequence that is to be expressed transgenically can be less than 200 bp (base pairs), or less than 100 bp or less than 50 bp.

Apart from promoters and terminators, examples of other regulatory elements that may be mentioned are targeting sequences, enhancers, polyadenylation signals, selectable markers, amplification signals, replication origins and the like. Suitable regulatory sequences are described for example in Goeddel, Gene Expression Technology: Methods in Enzymology 185, Academic Press, San Diego, Calif. (1990).

Nucleic acid constructs according to the invention comprise in particular sequences selected from those, specifically mentioned herein or derivatives and homologues thereof, as well as the nucleic acid sequences that can be derived from amino acid sequences specifically mentioned herein which are advantageously associated operatively or functionally with one or more regulating signal for controlling, e.g. increasing, gene expression.

In addition to these regulatory sequences, the natural regulation of these sequences can still be present in front of the actual structural genes and optionally can have been altered genetically, so that natural regulation is switched off and the expression of the genes has been increased. The nucleic acid construct can also be of a simpler design, i.e. without any additional regulatory signals being inserted in front of the coding sequence and without removing the natural promoter with its regulation. Instead, the natural regulatory sequence is silenced so that regulation no longer takes place and gene expression is increased.

A preferred nucleic acid construct advantageously also contains one or more of the aforementioned enhancer sequences, functionally associated with the promoter, which permit increased expression of the nucleic acid sequence. Additional advantageous sequences, such as other regulatory elements or terminators, can also be inserted at the 3' end of the DNA sequences. One or more copies of the nucleic acids according to the invention can be contained in the construct. The construct can also contain other markers, such as antibiotic resistances or auxotrophy-complementing genes, optionally for selection on the construct.

Examples of suitable regulatory sequences are contained in promoters such as cos-, tac-, trp-, tet-, trp-tet-, lpp-, lac-, lpp-lac-, lacI$^{q}$-, T7-, T5-, T3-, gal-, trc-, ara-, rhaP (rhaP$_{BAD}$) SP6-, lamb-da-P$_R$- or in the lambda-P$_L$ promoter, which find application advantageously in Gram-negative bacteria. Other advantageous regulatory sequences are contained for example in the Gram-positive promoters ace, amy and SPO2, in the yeast or fungal promoters ADC1, MFalpha, AC, P-60, CYC1, GAPDH, TEF, rp28, ADH. Artificial promoters can also be used for regulation.

For expression, the nucleic acid construct is inserted in a host organism advantageously in a vector, for example a plasmid or a phage, which permits optimum expression of the genes in the host. In addition to plasmids and phages, vectors are also to be understood as meaning all other vectors known to a person skilled in the art, e.g. viruses, such as SV40, CMV, baculovirus and adenovirus, transposons, IS elements, phasmids, cosmids, and linear or circular DNA. These vectors can be replicated autonomously in the host organism or can be replicated chromosomally. These vectors represent a further embodiment of the invention.

Suitable plasmids are, for example in *E. coli*, pLG338, pACYC184, pBR322, pUC18, pUC19, pKC30, pRep4, pHS1, pKK223-3, pDHE19.2, pHS2, pPLc236, pMBL24, pLG200, pUR290, pIN-III$^{113}$-B1, λgt11 or pBdCI; in nocardioform actinomycetes pJAM2; in *Streptomyces* pIJ101, pIJ364, pIJ702 or pIJ361; in *bacillus* pUB110, pC194 or pBD214; in *Corynebacterium* pSA77 or pAJ667; in fungi pALS1, pIL2 or pBB116; in yeasts 2alphaM, pAG-1, YEp6, YEp13 or pEMBLYe23 or in plants pLGV23, pGHlac$^+$, pBIN19, pAK2004 or pDH51. The aforementioned plasmids represent a small selection of the possible plasmids. Other plasmids are well known to a person skilled in the art and will be found for example in the book Cloning Vectors (Eds. Pouwels P. H. et al. Elsevier, Amster-dam-New York-Oxford, 1985, ISBN 0 444 904018).

In a further embodiment of the vector, the vector containing the nucleic acid construct according to the invention or the nucleic acid according to the invention can be inserted advantageously in the form of a linear DNA in the microorganisms and integrated into the genome of the host organism through heterologous or homologous recombination. This linear DNA can comprise a linearized vector such as plasmid or just the nucleic acid construct or the nucleic acid according to the invention.

For optimum expression of heterologous genes in organisms, it is advantageous to alter the nucleic acid sequences in accordance with the specific codon usage employed in the organism. The codon usage can easily be determined on the basis of computer evaluations of other, known genes of the organism in question.

The production of an expression cassette according to the invention is based on fusion of a suitable promoter with a suitable coding nucleotide sequence and a terminator signal or polyadenylation signal. Common recombination and cloning techniques are used for this, as described for example in T. Maniatis, E. F. Fritsch and J. Sambrook, Molecular Cloning: A Laboratory Manual, Cold Spring Harbor Laboratory, Cold Spring Harbor, N.Y. (1989) as well as in T. J. Silhavy, M. L. Berman and L. W. Enquist, Experiments with Gene Fusions, Cold Spring Harbor Laboratory, Cold Spring Harbor, N.Y. (1984) and in Ausubel, F. M. et al., Current Protocols in Molecular Biology, Greene Publishing Assoc. and Wiley Interscience (1987).

The recombinant nucleic acid construct or gene construct is inserted advantageously in a host-specific vector for expression in a suitable host organism, to permit optimum expression of the genes in the host. Vectors are well known to a person skilled in the art and will be found for example in "Cloning Vectors" (Pouwels P. H. et al., Publ. Elsevier, Amsterdam-New York-Oxford, 1985).

6. Hosts that can be Used According to the Invention

Depending on the context, the term "microorganism" means the starting microorganism (wild-type) or a genetically modified microorganism according to the invention, or both.

The term "wild-type" means, according to the invention, the corresponding starting microorganism, and need not necessarily correspond to a naturally occurring organism.

By means of the vectors according to the invention, recombinant microorganisms can be produced, which have been transformed for example with at least one vector according to the invention and can be used for production of the polypeptides according to the invention. Advantageously, the recombinant constructs according to the invention, described above, are inserted in a suitable host system and expressed. Preferably, common cloning and transfection methods that are familiar to a person skilled in the art are used, for example co-precipitation, protoplast fusion, electroporation, retroviral transfection and the like, in order to secure expression of the stated nucleic acids in the respective expression system. Suitable systems are described for example in Current Protocols in Molecular Biology, F. Ausubel et al., Publ. Wiley Interscience, New York 1997, or Sambrook et al. Molecular Cloning: A Laboratory Manual. 2nd edition, Cold Spring Harbor Laboratory, Cold Spring Harbor Laboratory Press, Cold Spring Harbor, N.Y., 1989.

In principle, all prokaryotic organisms can be considered as recombinant host organisms for the nucleic acid according to the invention or the nucleic acid construct. Bacteria are used advantageously as host organisms. Preferably they are selected from native or recombinant bacteria having the ability to produce inclusion bodies of the PHA-, TAG- or WE-type, as in particular the TAG-producing nocardioform actinomycetes, in particular of the genus *Rhodococcus, Mycobacterium, Nocardia, Gordonia, Skermania* and *Tsukamurella*; as well as TAG-producing Streptomycetes; WE-producing genera *Acinetobacter* and *Alcanivorax*; as well as recombinant strains of the genus *Escherichia*, especially *E. coli, Corynebacterium*, especially *C. glutamicum* und *Bacillus*, especially *B. subtilis*.

The host organism or host organisms according to the invention then preferably contain at least one of the nucleic acid sequences, nucleic acid constructs or vectors described in this invention, which code for an enzyme activity according to the above definition.

The organisms used in the method according to the invention are grown or bred in a manner familiar to a person skilled in the art, depending on the host organism. As a rule, microorganisms are grown in a liquid medium, which contains a source of carbon, generally in the form of sugars, a source of nitrogen generally in the form of organic sources of nitrogen such as yeast extract or salts such as ammonium sulfate, trace elements such as iron, manganese and magnesium salts and optionally vitamins, at temperatures between 0° C. and 100° C., preferably between 10° C. to 60° C. with oxygen aeration. The pH of the liquid nutrient medium can be maintained at a fixed value, i.e. regulated or not regulated during growing. Growing can be carried out batch wise, semi-batch wise or continuously. Nutrients can be supplied at the start of fermentation or can be supplied subsequently, either semi-continuously or continuously.

7. Recombinant Production of Enzymes of the Invention

The invention also relates to methods for production of enzymes used in methods according to the invention by cultivating a microorganism which expresses said enzyme, and isolating the desired product from the culture.

The microorganisms as used according to the invention can be cultivated continuously or discontinuously in the batch process or in the fed batch or repeated fed batch process. A review of known methods of cultivation will be found in the textbook by Chmiel (Bioprocesstechnik 1. Einfuhrung in die Bioverfahrenstechnik (Gustav Fischer Verlag, Stuttgart, 1991)) or in the textbook by Storhas (Bioreaktoren und periphere Einrichtungen (Vieweg Verlag, Braunschweig/Wiesbaden, 1994)).

The culture medium that is to be used must satisfy the requirements of the particular strains in an appropriate manner. Descriptions of culture media for various microorganisms are given in the handbook "Manual of Methods for General Bacteriology" of the American Society for Bacteriology (Washington D. C., USA, 1981).

These media that can be used according to the invention generally comprise one or more sources of carbon, sources of nitrogen, inorganic salts, vitamins and/or trace elements.

Preferred sources of carbon are sugars, such as mono-, di- or polysaccharides. Very good sources of carbon are for example glucose, fructose, mannose, galactose, ribose, sorbose, ribulose, lactose, maltose, sucrose, raffinose, starch or cellulose. Sugars can also be added to the media via complex compounds, such as molasses, or other by-products from sugar refining. It may also be advantageous to add mixtures of various sources of carbon. Other possible sources of carbon are oils and fats such as soybean oil, sunflower oil, peanut oil and coconut oil, fatty acids such as palmitic acid, stearic acid or linoleic acid, alcohols such as glycerol, methanol or ethanol and organic acids such as acetic acid or lactic acid.

Sources of nitrogen are usually organic or inorganic nitrogen compounds or materials containing these compounds. Examples of sources of nitrogen include ammonia gas or ammonium salts, such as ammonium sulfate, ammonium chloride, ammonium phosphate, ammonium carbonate or ammonium nitrate, nitrates, urea, amino acids or complex sources of nitrogen, such as corn-steep liquor, soybean flour, soybean protein, yeast extract, meat extract and others. The sources of nitrogen can be used separately or as a mixture.

Inorganic salt compounds that may be present in the media comprise the chloride, phosphate or sulfate salts of calcium, magnesium, sodium, cobalt, molybdenum, potassium, manganese, zinc, copper and iron.

Inorganic sulfur-containing compounds, for example sulfates, sulfites, dithionites, tetrathionates, thiosulfates, sulfides, but also organic sulfur compounds, such as mercaptans and thiols, can be used as sources of sulfur.

Phosphoric acid, potassium dihydrogenphosphate or dipotassium hydrogenphosphate or the corresponding sodium-containing salts can be used as sources of phosphorus.

Chelating agents can be added to the medium, in order to keep the metal ions in solution. Especially suitable chelating agents comprise dihydroxyphenols, such as catechol or protocatechuate, or organic acids, such as citric acid.

The fermentation media used according to the invention may also contain other growth factors, such as vitamins or growth promoters, which include for example biotin, riboflavin, thiamine, folic acid, nicotinic acid, pantothenate and pyridoxine. Growth factors and salts often come from complex components of the media, such as yeast extract, molasses, corn-steep liquor and the like. In addition, suitable precursors can be added to the culture medium. The precise composition of the compounds in the medium is strongly dependent on the particular experiment and must be decided individually for each specific case. Information on media optimization can be found in the textbook "Applied Microbiol. Physiology, A Practical Approach" (Publ. P. M. Rhodes, P. F. Stanbury, IRL Press (1997) p. 53-73, ISBN 0 19 963577 3). Growing media can also be obtained from commercial suppliers, such as Standard 1 (Merck) or BHI (Brain heart infusion, DIFCO) etc.

All components of the medium are sterilized, either by heating (20 min at 1.5 bar and 121° C.) or by sterile filtration. The components can be sterilized either together, or if necessary separately. All the components of the medium can be present at the start of growing, or optionally can be added continuously or by batch feed.

The temperature of the culture is normally between 15° C. and 45° C., preferably 25° C. to 40° C. and can be kept constant or can be varied during the experiment. The pH value of the medium should be in the range from 5 to 8.5, preferably around 7.0. The pH value for growing can be controlled during growing by adding basic compounds such as sodium hydroxide, potassium hydroxide, ammonia or ammonia water or acid compounds such as phosphoric acid or sulfuric acid. Anti-foaming agents, e.g. fatty acid polyglycol esters, can be used for controlling foaming. To maintain the stability of plasmids, suitable substances with selective action, e.g. antibiotics, can be added to the medium. Oxygen or oxygen-containing gas mixtures, e.g. the ambient air, are fed into the culture in order to maintain aerobic conditions. The temperature of the culture is normally from 20° C. to 45° C. Culture is continued until a maximum of the desired product has formed. This is normally achieved within 10 hours to 160 hours.

The cells can be disrupted optionally by high-frequency ultrasound, by high pressure, e.g. in a French pressure cell, by osmolysis, by the action of detergents, lytic enzymes or organic solvents, by means of homogenizers or by a combination of several of the methods listed.

8. Reaction Conditions for Biocatalytic Methods of the Invention

The at least one enzyme which is present during a method of the invention or an individual step of a multistep-method as defined herein above, can be present in living cells naturally or recombinantly producing the enzyme or enzymes, in harvested cells, in dead cells, in permeabilized cells, in crude cell extracts, in purified extracts, or in essentially pure or completely pure form. The at least one enzyme may be present in solution or as an enzyme immobilized on a carrier. One or several enzymes may simultaneously be present in soluble and immobilised form.

The methods according to the invention can be performed in common reactors, which are known to those skilled in the art, and in different ranges of scale, e.g. from a laboratory scale (few millilitres to dozens of liters of reaction volume) to an industrial scale (several liters to thousands of cubic meters of reaction volume). If the lipase is used in a form encapsulated by non-living, optionally permeabilized cells, in the form of a more or less purified cell extract or in purified form, a chemical reactor can be used. The chemical reactor usually allows controlling the amount of the at least one enzyme, the amount of the at least one substrate, the pH, the temperature and the circulation of the reaction medium. When the at least one enzyme is present in living cells, the process will be a fermentation. In this case the biocatalytic production will take place in a bioreactor (fermenter), where parameters necessary for suitable living conditions for the living cells (e.g. culture medium with nutrients, temperature, aeration, presence or absence of oxygen or other gases, antibiotics, and the like) can be controlled. Those skilled in the art are familiar with chemical reactors or bioreactors, e.g. with procedures for up-scaling chemical or biotechnological methods from laboratory scale to industrial scale, or for optimizing process parameters, which are also extensively described in the literature (for biotechnological methods see e.g. Crueger und Crueger, Biotechnologie—Lehrbuch der angewandten Mikrobiologie, 2. Ed., R. Oldenbourg Verlag, München, Wien, 1984).

Cells containing the at least one enzyme can be permeabilized by physical or mechanical means, such as ultrasound or radiofrequency pulses, French presses, or chemical means, such as hypotonic media, lytic enzymes and detergents present in the medium, or combination of such methods. Examples for detergents are digitonin, n-dodecylmaltoside, octylglycoside, Triton® X-100, Tween® 20, deoxycholate, CHAPS (3-[(3-Cholamidopropyl)dimethyl-ammonio]-1-propansulfonate), Nonidet 6 P40 (Ethylphenol-poly(ethyleneglycolether), and the like.

If the at least one enzyme is immobilised, it is attached to an inert carrier. Suitable carrier materials are known in the art and are, e.g., disclosed in EP-A-1149849, EP-A-1 069 183 and DE-OS 100193773 as well as the literature references cited therein (all of which are specifically enclosed with regard to carrier materials). Examples for suitable carrier materials are clays, clay minerals such as kaolinite, diatomeceous earth, perlite, silica, alumina, sodium carbonate, calcium carbonate, cellulose powder, anion exchanger materials, synthetic polymers, such as polystyrene, acrylic resins, phenol formaldehyde resins, polyurethanes and polyolefins, such as polyethylene and polypropylene. For preparing carrier-bound enzymes the carrier materials usually are used in the form of fine powders, wherein porous forms are preferred. The particle size of the carrier material usually does not exceed 5 mm, in particular 2 mm. In case the at least one enzyme is present in a whole-cell-preparation, said whole-cell-preparation may be present in a free or immobilised form. Suitable carrier materials are e.g. Ca-alginate or Carrageenan. Enzymes as well as cells may directly be linked by glutaraldehyde. A wide range of immobilisation methods is known in the art (e.g. J. Lalonde and A. Margolin "Immobilization of Enzymes" in K. Drauz und H. Waldmann, Enzyme Catalysis in Organic Synthesis 2002, Vol. III, 991-1032, Wiley-VCH, Weinheim).

The conversion reaction can be carried out batch wise, semi-batch wise or continuously. Reactants (and optionally nutrients) can be supplied at the start of reaction or can be supplied subsequently, either semi-continuously or continuously.

The reaction of the invention, depending on the particular reaction type, may be performed in an aqueous or non-aqueous reaction medium. Ester cleavage reaction are preferably performed in the presence of water, in particular in the present of an aqueous-organic solvent system, preferably a 2-phase system. Esterification reactions are predereably performed in the absence of water, more particularly in the presence of an organic solvent which is free or substantially free of water.

An aqueous medium may contain a suitable buffer in order to adjust the pH to a value in the range of 5 to 9, like 6 to 8.

The non-aqueous medium may contain is substantially free of water, i.e. will contain less that about 1 wt.-% or 0.5 wt.-% of water.

In particular, biocatalytic methods are performed in an organic non-aqueous medium. As suitable organic solvents there may be mentioned aliphatic hydrocarbons having for example 5 to 8 carbon atoms, like pentane, cyclopentane, hexane, cyclohexane, heptane, octane or cyclooctane; aromatic carbohydrates, like benzene, toluene, xylenes, chlorobenzene or dichlorobenzene, aliphatic acyclic and ethers, like diethylether, methyl-tert.-butylether, ethyl-tert.-butylether, dipropylether, diisopropylether, dibutylether; or mixtures thereof. Preferably an organic solvent is applied which has the ability to form a biphasic solvent system with water The concentration of the reactants/substrates may be adapted to the optimum reaction conditions, which may depend on the specific enzyme applied. For example, the initial substrate concentration may be in the 0.1 to 0.5 M, as for example 10 to 100 mM.

The reaction temperature may be adapted to the optimum reaction conditions, which may depend on the specific enzyme applied. For example, the reaction may be performed at a temperature in a range of from 0 to 70° C., as for example 20 to 50 or 25 to 40° C. Examples for reaction temperatures are about 30° C., about 35° C., about 37° C., about 40° C., about 45° C., about 50° C., about 55° C. and about 60° C.

The process may proceed until equilibrium between the substrate and then product(s) is achieved, but may be stopped earlier. Usual process times are in the range from 1 minute to 25 hours, in particular 10 min to 6 hours, as for example in the range from 1 hour to 4 hours, in particular 1.5 hours to 3.5 hours.

8.1 Selective Enzymatic Esterification of a 3-Unsaturated Carboxylic Acid, Likehomofarnesylic Acid In a preferred embodiment, a mixture of (3E/Z) isomers of the 3-unsaturated carboxylic acid, like in particular of (3E,7E)- and (3Z,7E)-homofarnesylic acid, an aliphatic alcohol and optionally an organic solvent is treated with the lipase enzyme for performing an esterification reaction.

Non-limiting examples of suitable lipases are Candida antarctica lipase (CALB), and the immobilized analog thereof, like Novozym 435®.

Non-limiting examples of suitable alcohols are aliphatic $C_1$-$C_{20}$-alcohols, as for example methanol, ethanol, n-propanol, i-propanol, n-butanol, i-butanol, sec.-butanol, n-pentanol, n-hexanol, n-heptanol and n-octanol.

Non-limiting examples of suitable solvents are in particular aliphatic hydrocarbons, as for example hexane, cyclohexane, heptane, octane; aromatic hydrocarbons, as for example toluene, xylene; dialkyl ethers, as for example MTBE and diisopropyl ether.

In a preferred embodiment, one equivalent alcohol is used per one equivalent of (3E)-carboxylic acid, in particular (3E,7E)-isomer of homofarnesylic acid, in order to obtain an essentially complete conversion. Applying low amounts of alcohol limits the ester yield.

The reaction is suitably performed in a temperature range of about 0° C. and +80° C. The progress of the reaction may be controlled by means of GC or HPLC analytics.

A separable acid/ester mixture of the carboxylic acid isomers is obtained.

8.2 Selective Enzymatic Saponification of 3-Unsaturated Carboxylic Acid Ester, Like Homofarnesylic Acid Esters In another embodiment a separable mixture of isomers is obtained by applying an enzyme catalyzed ester cleavage of an 3E/Z-isomer mixture of the 3-unsaturated carboxylic acid, in particular of a mixture of (3E,7E)- and (3Z,7E)-isomers of homofarnesylic acid alkyl esters. In a reaction the free 3E-acid, in particular (3E,7E)-homofarnesylic acid isomer and the non-reacted 3Z ester, in particular the non-reacted (3Z,7E)-homofarnesylic acid ester are obtained.

In a preferred embodiment an isomer mixture of the carboxylic acid alkyl esters, optionally dissolved in an organic solvent, is converted by applying a lipase enzyme in the presence of water.

Non-limiting examples of suitable lipases are Candida antarctica lipase (CALB), and the immobilized analog thereof, like Novozym 435®.

Non-limiting examples of suitable alkyl residues of the ester are: methyl, ethyl, n-propyl, i-propyl, n-butyl, i-butyl and sec-butyl Non-limiting examples of suitable solvents are aliphatic hydrocarbons as, for example, hexane cyclohexane, heptane; aromatic hydrocarbons, like toluene and xylene; ethers as, for example, MTBE and diisopropyl ether, THF.

8.3 Preparation of (−)-Ambrox

The preparation may be performed starting out from the stereoisomerically pure (3E/7E) homofarnesylic acid as obtained according to the present invention by applying known methods as depicted in the above Scheme 1.

The disclosure of EP16156410 and WO2010/139719 as stated in Scheme 1 as well as of WO2012/066059 describing the biocatalytic conversion of unsaturated substrates by applying cyclase enzymes of different origin is incorporated by reference.

Sclareolide, as for example obtained by the cyclase-catalyzed conversion of (3E/7E)-homofarnesylic acid of the invention which then is chemically reduced (for example by means of $LiAlH_4$ or $NaBH4$) to form a mbrox-1,4-diol [Mookherjee et al.; Perfumer and Flavourist (1990), 15:27]. Ambrox-1,4-diol may then be chemically converted by means of different processes to (−)-ambrox. (see for example U.S. Pat. No. 5,274,134).

The biocatalytic synthesis of compound (−)-ambrox is also described in the literature [Neumann et al.; Biol Chem Hoppe Seyler (1986), 367:723]. The molecule is obtained from homofarnesol ((3Z,7E)-4,8,12-trimethyltrideca-3,7,11-trien-1-ol and the squalene-hopen cyclase (SHC) from Alicyclobacillus acidocaldarius (formerly Bacillus acidocaidarius) was used as the catalyst.

9. Product Isolation

The methodology of the present invention can further include a step of recovering an end or intermediate product, optionally in stereoisomerically or enantiomerically substantially pure form. The term "recovering" includes extracting, harvesting, isolating or purifying the compound from culture or reaction media. Recovering the compound can be performed according to any conventional isolation or purification methodology known in the art including, but not limited to, treatment with a conventional resin (e.g., anion or cation exchange resin, non-ionic adsorption resin, etc.), treatment with a conventional adsorbent (e.g., activated charcoal, silicic acid, silica gel, cellulose, alumina, etc.), alteration of pH, solvent extraction (e.g., with a conventional solvent such as an alcohol, ethyl acetate, hexane and the like), distillation, dialysis, filtration, concentration, crystallization, recrystallization, pH adjustment, lyophilization and the like.

Identity and purity of the isolated product may be determined by known techniques, like High Performance Liquid Chromatography (HPLC), gas chromatography (GC), Spektroskopy (like IR, UV, NMR), Colouring methods, TLC, NIRS, enzymatic or microbial assays. (see for example: Patek et al. (1994) Appl. Environ. Microbiol. 60:133-140; Malakhova et al. (1996) Biotekhnologiya 11 27-32; und Schmidt et al. (1998) Bioprocess Engineer. 19:67-70. Ullmann's Encyclopedia of Industrial Chemistry (1996) Bd. A27, VCH: Weinheim, S. 89-90, S. 521-540, S. 540-547, S. 559-566, 575-581 und S. 581-587; Michal, G (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, Bd. 17.)

The following examples only serve to illustrate the invention. The numerous possible variations that are obvious to a person skilled in the art also fall within the scope of the invention.

EXPERIMENTAL PART

A. Materials (1) Enzymes

Lipase: Novozym 435; commercial product of Novozymes; immobilized *Candida antarctica* lipase B
Amino Acid Sequence:

```
  1  MKLLSLTGVA GVLATCVAAT PLVKRLPSGS DPAFSQPKSV LDAGLTCQGA SPSSVSKPIL

61  LVPGTGTTGP QSFDSNWIPL STQLGYTPCW ISPPPFMLND TQVNTEYMVN AITALYAGSG

121  NNKLPVLTWS QGGLVAQWGL TFFPSIRSKV DRLMAFAPDY KGTVLAGPLD ALAVSAPSVW

181  QQTTGSALTT ALRNAGGLTQ IVPTTNLYSA TDEIVQPQVS NSPLDSSYLF NGKNVQAQAV

241  CGPLFVIDHA GSLTSQFSYV VGRSALRSTT GQARSADYGI TDCNPLPAND LTPEQKVAAA

301  ALLAPAAAAI VAGPKQNCEP DLMPYARPFA VGKRTCSGIV TP
```

Cyclase: Zm-SHC-1 See Below

Unless otherwise specified, recombinant proteins are cloned and expressed by standard methods, such as, for example, as described by Sambrook, J., Fritsch, E. F. and Maniatis, T., Molecular cloning: A Laboratory Manual, $2^{nd}$ Edition, Cold Spring Harbor Laboratory, Cold Spring Harbor Laboratory Press, Cold Spring Harbor, N.Y., 1989.

(2) Chemicals

Isomer mixtures of homofarnesylic acid are for example obtained by a method as described in European Patent Application, application Number EP 17157950.1 filed on Feb. 24, 2017.

Isomer mixtures of homofarnesylic acid esters have been prepared (e.g. in accordance with the generally known add-catalyzed esterification of carboxylic acids with alcohols (so-called Fischer esterification—Chemische Berichte 28, 1895, 3252-3258) from isomeric mixtures of homofarnesylic acid.

All other chemical as applied were of laboratory grade.

B. Methods:

1. HPLC Parameters for the Analysis of Homofarnesylic Acid Compounds
Apparatus: Agilent Series 1100
Column: Chiralpak AD-RH 5 μm 150*4.6 mm von Daicel®
Eluent: —A: Water with 0.1 Vol % $H_3PO_4$
—B: Acetonitrile mit 0.1 Vol % $H_3PO_4$

| Time in min | % B | Flow |
|---|---|---|
| 0.0 | 30 | 1.2 |
| 25.0 | 70 | 1.2 |
| 30.0 | 100 | 1.2 |
| 30.1 | 30 | 1.2 |

Detector: UV-Detector X=205 nm, BW=5 nm
Flow rate: 1.2 ml/min
Injection: 5

Temp.: 40° C.
Duration: 35 min
Pressure: approx. 70 bar

| Homofarnesylic acid | Ester | Retention time [min] |
|---|---|---|
| 3Z,7E | — | 10.31 |
| 3E,7E | — | 11.73 |
| 3Z,7E | Methyl ester | 17.33 |
| 3E,7E | Methyl ester | 19.37 |
| 3Z,7E | Ethyl ester | 18.87 |
| 3E,7E | Ethyl ester | 21.28 |
| 3Z,7E | iso-Propyl ester | 20.06 |
| 3E,7E | iso-Propyl ester | 21.73 |
| 3Z,7E | Butyl ester | 23.25 |

-continued

| Homofarnesylic acid | Ester | Retention time [min] |
|---|---|---|
| 3E,7E | Butyl ester | 26.24 |
| 3Z,7E | Octyl ester | 29.77 |
| 3E,7E | Octyl ester | 30.88 |

2. GC Parameters for the Analysis of Sclareolide
The conversion of homofarnesylic acid into sclareolide can be determined with the following GC system:
Column: 10 m Optima 1
Temperature profile:
 0 min: 100° C.
 5° C./min to 200° C.
 After 5 min
 30° C./min to 320° C.
 thereafter constant
 Duration of the method: 30 min
Injector temperature: 280° C.
Retention times (RT):
 Homofarnesylic acid: peak 1 at 11.7 min, peak 2 at 12.1 min;
 Sclareolide: approx. 13.5 min
A calibration series, with the aid of which the concentration of unknown samples was determined, is established using authentic material (Sigma, catalog No.: 358002).

2. Lipase Activity Measurement
Tributyrin Assay according to Beisson, F. et al. Eur. J. Lipid Sci. Technol. 2000, 133-153.

B. Examples

Reference Example 1: Cloning of the Zm-SHC-1 and Expression in *E. coli*

The gene of the cyclase may be amplified from *Zymomonas mobilis* with the aid of the oligonucleotides Zm-SHC_fw and Zm-SHC_rev.

| Primer: | | |
|---|---|---|
| Primer No. | sequence (5' -> 3') | Position |
| Zm-SHC_fw | gcgctgtttcatatgggtattgaca (SEQ ID NO: 327) | N-term primer |
| Zm-SHC_rev | gcgcttaccctggatcctcgaaaat (SEQ ID NO: 328) | C-term primer |

In each case 100 ng of primers Zm-SHC_fw and Zm-SHC_rev were mixed in an equimolar ratio. The PCR with genomic DNA from *Z. mobilis* (ATCC31821) was carried out following the manufacturer's instructions using Pwo-polymerase (Roche Applied Science) and the following temperature gradient program: 95° C. for 3 min; 30 cycles at 95° C. for 30 sec., 50° C. for 30 sec and 72° C. for 3 min; 72° C. for 10 min.; 4° C. until used. The PCR product (~2.2 kb) was isolated by agarose gel electrophoresis (1.2% electrophoresis gel, Invitrogen) and column chromatography (GFX Kit, Amersham Pharmacia) and subsequently sequenced (sequencing primer: Zm-SHC_fw and Zm-SHC_rev). The sequence obtained matches the published sequence.

The PCR product was digested with the restriction endonucleases NdeI and BamHI and ligated into suitably digested vector pDHE19.2 [9]. Sequencing the resulting plasmids gave the nucleic acid sequence shown in SEQ ID NO: 1. The corresponding amino acid sequence is shown in the following text/(SEQ ID NO:2):

```
Met Gly Ile Asp Arg Met Asn Ser Leu Ser Arg Leu Leu Met Lys Lys
 1               5                  10                  15

Ile Phe Gly Ala Glu Lys Thr Ser Tyr Lys Pro Ala Ser Asp Thr Ile
                20                  25                  30

Ile Gly Thr Asp Thr Leu Lys Arg Pro Asn Arg Arg Pro Glu Pro Thr
                35                  40                  45

Ala Lys Val Asp Lys Thr Ile Phe Lys Thr Met Gly Asn Ser Leu Asn
            50                  55                  60

Asn Thr Leu Val Ser Ala Cys Asp Trp Leu Ile Gly Gln Gln Lys Pro
 65                  70                  75                  80

Asp Gly His Trp Val Gly Ala Val Glu Ser Asn Ala Ser Met Glu Ala
                85                  90                  95

Glu Trp Cys Leu Ala Leu Trp Phe Leu Gly Leu Glu Asp His Pro Leu
               100                 105                 110

Arg Pro Arg Leu Gly Asn Ala Leu Leu Glu Met Gln Arg Glu Asp Gly
           115                 120                 125

Ser Trp Gly Val Tyr Phe Gly Ala Gly Asn Gly Asp Ile Asn Ala Thr
           130                 135                 140

Val Glu Ala Tyr Ala Ala Leu Arg Ser Leu Gly Tyr Ser Ala Asp Asn
145                 150                 155                 160

Pro Val Leu Lys Lys Ala Ala Ala Trp Ile Ala Glu Lys Gly Gly Leu
               165                 170                 175

Lys Asn Ile Arg Val Phe Thr Arg Tyr Trp Leu Ala Leu Ile Gly Glu
               180                 185                 190

Trp Pro Trp Glu Lys Thr Pro Asn Leu Pro Pro Glu Ile Ile Trp Phe
           195                 200                 205

Pro Asp Asn Phe Val Phe Ser Ile Tyr Asn Phe Ala Gln Trp Ala Arg
           210                 215                 220

Ala Thr Met Val Pro Ile Ala Ile Leu Ser Ala Arg Arg Pro Ser Arg
225                 230                 235                 240

Pro Leu Arg Pro Gln Asp Arg Leu Asp Glu Leu Phe Pro Glu Gly Arg
               245                 250                 255

Ala Arg Phe Asp Tyr Glu Leu Pro Lys Lys Glu Gly Ile Asp Leu Trp
               260                 265                 270

Ser Gln Phe Phe Arg Thr Thr Asp Arg Gly Leu His Trp Val Gln Ser
           275                 280                 285

Asn Leu Leu Lys Arg Asn Ser Leu Arg Glu Ala Ala Ile Arg His Val
           290                 295                 300

Leu Glu Trp Ile Ile Arg His Gln Asp Ala Asp Gly Gly Trp Gly Gly
305                 310                 315                 320

Ile Gln Pro Pro Trp Val Tyr Gly Leu Met Ala Leu His Gly Glu Gly
               325                 330                 335
```

```
Tyr Gln Leu Tyr His Pro Val Met Ala Lys Ala Leu Ser Ala Leu Asp
                340                 345                 350

Asp Pro Gly Trp Arg His Asp Arg Gly Glu Ser Ser Trp Ile Gln Ala
            355                 360                 365

Thr Asn Ser Pro Val Trp Asp Thr Met Leu Ala Leu Met Ala Leu Lys
        370                 375                 380

Asp Ala Lys Ala Glu Asp Arg Phe Thr Pro Glu Met Asp Lys Ala Ala
385                 390                 395                 400

Asp Trp Leu Leu Ala Arg Gln Val Lys Val Lys Gly Asp Trp Ser Ile
                405                 410                 415

Lys Leu Pro Asp Val Glu Pro Gly Gly Trp Ala Phe Glu Tyr Ala Asn
                420                 425                 430

Asp Arg Tyr Pro Asp Thr Asp Thr Ala Val Ala Leu Ile Ala Leu
            435                 440                 445

Ser Ser Tyr Arg Asp Lys Glu Glu Trp Gln Lys Lys Gly Val Glu Asp
            450                 455                 460

Ala Ile Thr Arg Gly Val Asn Trp Leu Ile Ala Met Gln Ser Glu Cys
465                 470                 475                 480

Gly Gly Trp Gly Ala Phe Asp Lys Asp Asn Asn Arg Ser Ile Leu Ser
                485                 490                 495

Lys Ile Pro Phe Cys Asp Phe Gly Glu Ser Ile Asp Pro Pro Ser Val
                500                 505                 510

Asp Val Thr Ala His Val Leu Glu Ala Phe Gly Thr Leu Gly Leu Ser
                515                 520                 525

Arg Asp Met Pro Val Ile Gln Lys Ala Ile Asp Tyr Val Arg Ser Glu
            530                 535                 540

Gln Glu Ala Glu Gly Ala Trp Phe Gly Arg Trp Gly Val Asn Tyr Ile
545                 550                 555                 560

Tyr Gly Thr Gly Ala Val Leu Pro Ala Leu Ala Ala Ile Gly Glu Asp
                565                 570                 575

Met Thr Gln Pro Tyr Ile Thr Lys Ala Cys Asp Trp Leu Val Ala His
            580                 585                 590

Gln Gln Glu Asp Gly Gly Trp Gly Glu Ser Cys Ser Ser Tyr Met Glu
            595                 600                 605

Ile Asp Ser Ile Gly Lys Gly Pro Thr Thr Pro Ser Gln Thr Ala Trp
            610                 615                 620

Ala Leu Met Gly Leu Ile Ala Ala Asn Arg Pro Glu Asp Tyr Glu Ala
625                 630                 635                 640

Ile Ala Lys Gly Cys His Tyr Leu Ile Asp Arg Gln Glu Gln Asp Gly
                645                 650                 655

Ser Trp Lys Glu Glu Phe Thr Gly Thr Gly Phe Pro Gly Tyr Gly
            660                 665                 670

Val Gly Gln Thr Ile Lys Leu Asp Asp Pro Ala Leu Ser Lys Arg Leu
            675                 680                 685

Leu Gln Gly Ala Glu Leu Ser Arg Ala Phe Met Leu Arg Tyr Asp Phe
        690                 695                 700

Tyr Arg Gln Phe Phe Pro Ile Met Ala Leu Ser Arg Ala Glu Arg Leu
705                 710                 715                 720

Ile Asp Leu Asn Asn
            725
```

The plasmid pDHE-Zm-SHC-1 was transformed into the strain *E. coli* TG10 pAgro4 pHSG575 [Takeshita et al., Gene 1987, 61:63-74; Tomoyasu et al., *Mol Microbiol* 2001, 40:397-413]. The recombinant *E. coli* were named *E. coli* LU15568.

Reference Example 2: Provision of Recombinant Homofarnesol Cyclase from *Z. mobilis*

Inoculated from a suitable 2 ml preculture, *E. coli* LU15568 was grown for 16 h at 37° C. in 20 ml LB-Amp/Spec/Cm (100 µg/l ampicillin; 100 µg/l spectinomycin; 20 µg/l chloramphenicol), 0.1 mM IPTG, 0.5 g/l rhamnose in 100 ml Erlenmeyer flasks (with baffles), centrifuged at 5000*g/10 min and stored at 4° C. Protein extract was prepared by suspending the cell pellet in 15 ml disruption buffer (0.2 M Tris/HCl, 0.5 M EDTA, pH 8.0), 375 U benzonase (for example Novagen, 25 U/µL), 40 µL PMSF (100 mM, dissolved in i-PropOH), 0.8 g sucrose and approx. 0.5 mg of lysozyme. The reaction mixture was mixed and incubated on ice for 30 min. Thereafter, the mixture was frozen at −20° C.

After the reaction mixture had defrosted, it was made up to approx. 40 ml with distilled water and again incubated on ice for 30 min.

Thereafter, the cells were disrupted 3 times for 3 min using ultrasound (HTU-Soni 130, by G. Heinemann, Schwäbisch-Hall, amplitude 80%, 15" pulse/15" pause). After the disruption, the cell debris was removed by centrifugation for 60 min at 4° C. and 26 900*g. The supernatant was discarded and the pellet was resuspended in 100 ml solubilization buffer (50 mM Tris/HCl, 10 mM MgCl2× 6H2O, 1% Triton X-100, pH 8.0) and comminuted in a Potter for approx. 5 min. Thereafter, the suspension was maintained on ice for 30 min.

The homogenized extract was recentrifuged for 1 h at 4° C. and 26 900*g, and the pellet was discarded. The extract was employed for the enzyme assays and may be stored over several weeks at −20° C. without suffering activity losses. The protein content was in the range of 1 mg/ml.

Reference Example 3: Activity Determination of the Recombinant Cyclase from *E. coli* LU15568

Homofarnesylic acid ((3E,7E)-4,8,12-trimethyltrideca-3, 7,11-trienoic acid) was incubated with the protein preparation described in Reference Example 2. Specifically, 0.0412 g of homofarnesylic acid were weighed (20 mM in the reaction mixture; purity 85.1% composed of Z,Z 0.44%, E,Z 10.13%, E,E 74.93%), 2.913 ml of water; 0.350 ml of sodium citrate buffer (1 M sodium citrate pH 5.4), 0.560 ml MgCl2 (0.5M solution) were pipetted in, and the mixture was warmed for 30 min at 37° C., with stirring. The reaction started with the addition of *E. coli* LU15568 homogenate (protein content 35 mg/ml), warmed to 37° C. The reaction mixture was stirred on a magnetic stirrer in an oil bath for 24 h at pH 5.0 at 37° C. at maximum stirring speed. The pH was adjusted during the reaction using 0.5M HCl. After incubation for 24 hours, 0.500 ml from the reaction mixture were extracted by vortexing for 30 seconds with 1000 ml of n-heptane/n-propanol 3:2. The organic supernatant after the phase separation was employed in the GC analysis (cf. FIG. 1).

Using the analyses described herein below in greater detail, a conversion rate of 74.5% in total of 82.7% from the E,E isomer was determined.

Example 1: Preparation of (3E,7E)-Homofarnesylic Acid Butyl Ester 71 g (283 mmol) of a mixture of (3E,7E)-homofarnesylic acid and (3Z,7E)-homofarnesylic acid in a molar ratio of 56:44 were dissolved in 360 ml of n-heptane. 21 g (283 mmol) of n-butanol and 470 mg Novozym 435 were added. The mixture was stirred for 48 h at 23° C. The enzyme was separated by filtration. At a temperature of 0° C., 115 ml of methanol and 5 ml of water were added. The pH of the mixture was adjusted to pH=12 by adding aqueous sodium hydroxide (25%) at a temperature of <10° C. and under agitation.

The stirrer was stopped and the lower phase was separated off. After removal of the solvent, 43.5 g (119 mmol) of the homofarnesylic acid butyl ester having a (3E,7E)-content of >97% were obtained.

Example 2: Influence of Different Alcohols on Selectivity of Enzymatic Esterification of Homofarnesylic Acid in the Absence of a Solvent 2 g (8 mmol) of a 57:43 mixture of (3E,7E)-homofarnesylic acid and (3Z,7E)-homofarnesylic acid were dissolved in 15 ml of different alcohols and were stirred at 23° C. in the presence of 20 mg Novozym 435. At particular time intervals the composition of the reaction mixture was analyzed by HPLC. The results are summarized in the subsequent Table 1.

TABLE 1

| HFS Mixture | Alcohol ROH | | Solvent | | Novozynne 435 | Time | 3Z, 7E Acid | 3E, 7E Acid | 3Z, 7E Ester | 3E, 7E Ester |
|---|---|---|---|---|---|---|---|---|---|---|
| [mmol] | [g] | Type | mL | Type | mL | mg | [h] | Fl% | Fl% | Fl% | Fl% |
| 8 | 2 | EtOH | 15 | none | — | 20 | 0 | 43 | 57 | — | — |
| | | | | | | | 5 | 43 | 49 | <1 | 9 |
| | | | | | | | 8 | 42 | 44 | <1 | 13 |
| | | | | | | | 24 | 42 | 27 | <1 | 30 |
| | | | | | | | 32 | 42 | 21 | 1 | 36 |
| 8 | 2 | iPrOH | 15 | none | — | 20 | 0 | 43 | 57 | — | — |
| | | | | | | | 5 | 43 | 52 | <1 | 5 |
| | | | | | | | 8 | 43 | 49 | <1 | 9 |
| | | | | | | | 24 | 43 | 35 | <1 | 22 |
| | | | | | | | 32 | 42 | 29 | <1 | 29 |
| 8 | 2 | BuOH | 15 | none | — | 20 | 0 | 43 | 57 | — | — |
| | | | | | | | 5 | 43 | 52 | <1 | 5 |
| | | | | | | | 8 | 43 | 49 | <1 | 9 |
| | | | | | | | 24 | 43 | 34 | <1 | 23 |
| | | | | | | | 32 | 42 | 28 | 1 | 29 |

TABLE 1-continued

| HFS Mixture [mmol] | Alcohol ROH [g] | | Solvent | | Novozyme 435 mg | Time [h] | 3Z, 7E Acid Fl% | 3E, 7E Acid Fl% | 3Z, 7E Ester Fl% | 3E, 7E Ester Fl% |
|---|---|---|---|---|---|---|---|---|---|---|
| | | Type | mL | Type | mL | | | | | |
| 8 | 2 | tBuOH | 15 | none | — | 20 | 0 | 43 | 57 | — | — |
| | | | | | | | 5 | 43 | 57 | — | — |
| | | | | | | | 8 | 43 | 57 | — | — |
| | | | | | | | 24 | 43 | 57 | — | — |
| | | | | | | | 32 | 43 | 57 | — | — |

Example 3: The Influence of a Combination of Different Alcohols and the Solvent Heptane on the Selectivity of Enzymatic Esterification of Homofarnesylic Acid 2 g (8 mmol) of a 57:43 mixture of (3E,7E)-homofarnesylic acid and (3Z,7E)-homofarnesylic acid were dissolved in 15 ml of heptane. 8 mmol of different alcohols and 20 mg Novozym 435 were added and the mixture was stirred at 23° C. At predetermined time intervals the composition of the reaction mixture was analyzed via HPLC. The results are shown in Table 2.

TABLE 2

| HFS Mixture [mmole] | Alcohol ROH [g] | | | Solvent | | Novozyme 435 mg | Time [h] | 3Z, 7E Acid Fl% | 3E, 7E Acid Fl% | 3Z, 7E Ester Fl% | 3E, 7E Ester Fl% |
|---|---|---|---|---|---|---|---|---|---|---|---|
| | | Type | mg | Type | mL | | | | | | |
| 8 | 2 | MeOH | 256 | Heptane | 15 | 20 | 0 | 43 | 57 | — | — |
| | | | | | | | 7.5 | 41 | 22 | 1 | 35 |
| | | | | | | | 24 | 37 | 2 | 6 | 55 |
| | | | | | | | 32 | 33 | 2 | 10 | 55 |
| 8 | 2 | EtOH | 370 | Heptane | 15 | 20 | 0 | 43 | 57 | — | — |
| | | | | | | | 7.5 | 42 | 23 | 1 | 35 |
| | | | | | | | 24 | 40 | 4 | 3 | 53 |
| | | | | | | | 32 | 38 | 3 | 5 | 54 |
| 8 | 2 | iPrOH | 480 | Heptane | 15 | 20 | 0 | 43 | 57 | — | — |
| | | | | | | | 7.5 | 43 | 44 | <1 | 13 |
| | | | | | | | 24 | 43 | 27 | <1 | 30 |
| | | | | | | | 32 | 43 | 20 | <1 | 38 |
| 8 | 2 | BuOH | 600 | Heptane | 15 | 20 | 0 | 43 | 57 | — | — |
| | | | | | | | 7.5 | 42 | 30 | 1 | 27 |
| | | | | | | | 24 | 41 | 4 | 1 | 53 |
| | | | | | | | 32 | 40 | 3 | 2 | 55 |
| 8 | 2 | 1-Octanol | 1050 | Heptane | 15 | 20 | 0 | 43 | 57 | — | — |
| | | | | | | | 7.5 | 43 | 22 | 1 | 35 |
| | | | | | | | 24 | 41 | 2 | 3 | 52 |
| | | | | | | | 32 | 41 | 1 | 5 | 54 |

Example 4: The Influence of a Combination of Butanol and Different Solvents on the Selectivity, of Enzymatic Esterification of Homofarnesylic Acid 2 g (8 mmol) of a 57:43 mixture of (3E,7E)-homofarnesylic acid and (3Z,7E)-homofarnesylic acid were dissolved in 15 ml of different solvents. 8 mmol butanol and 20 mg Novozym 435 were added and the mixture was stirred at 23° C. At predetermined time intervals the composition of the reaction mixture was analyzed via HPLC. The results are shown in Table 3.

TABLE 3

| HFS Mixture [mmole] | Alcohol ROH [g] | | Solvent | | Novozyme 435 mg | Time [h] | 3Z,7E Acid Fl% | 3E,7E Acid Fl% | 3Z,7E Ester Fl% | 3E,7E Ester Fl% |
|---|---|---|---|---|---|---|---|---|---|---|
| | | Type | mg | Type | mL | | | | | |
| 8 | 2 | BuOH | 600 | Toluene | 15 | 20 | 0 | 43 | 57 | — | — |
| | | | | | | | 7 | 42 | 36 | <1 | 22 |
| | | | | | | | 24 | 42 | 9 | 1 | 48 |
| | | | | | | | 31 | 41 | 5 | 2 | 52 |
| 8 | 2 | BuOH | 600 | THF | 15 | 20 | 0 | 43 | 57 | — | — |
| | | | | | | | 7 | 43 | 57 | 0 | 0 |
| | | | | | | | 24 | 43 | 57 | 0 | 0 |
| | | | | | | | 31 | 43 | 55 | 0 | 2 |
| 8 | 2 | BuOH | 600 | MTBE | 15 | 20 | 0 | 43 | 57 | — | — |
| | | | | | | | 7 | 42 | 42 | <1 | 16 |
| | | | | | | | 24 | 42 | 16 | 1 | 42 |
| | | | | | | | 31 | 41 | 12 | 1 | 45 |
| 8 | 2 | BuOH | 600 | CH2Cl2 | 15 | 20 | 0 | 43 | 57 | — | — |
| | | | | | | | 7 | 43 | 56 | 0 | 1 |
| | | | | | | | 24 | 43 | 53 | 0 | 4 |
| | | | | | | | 31 | 43 | 52 | 0 | 5 |

Example 5: Preparation of Free (3E,7E)-Homofarnesylic Acid Via Enzymatic Ester Cleavage 2 g (7.56 mmol) of (3E,7E)- and (3Z,7E)-homofarnesylic acid methyl ester (ratio of (3E,7E):(3Z,7E)=51:49) were dissolved in 50 ml of toluene. 10 ml of water and 50 mg of Novozym 435 were added. The mixture was stirred at 23° C. After 6 hours the composition of the reaction mixture was analyzed to be as follows:

36% (3E,7E)-homofarnesylic acid methyl ester,
49% (3Z,7E)-homofarnesylic acid methyl ester,
15% (3E,7E)-homofarnesylic acid and
<0.1% (3Z,7E)-homofarnesylic acid.

The enzyme was removed by filtration and the reaction mixture is adjusted to pH>9 by means of sodium carbonate. The aqueous lower phase was separated. The pH of the aqueous phase was adjusted to a value of <4 by means of an acid (10% hydrochloric acid). Afterwards the phase is extracted with toluene. The obtained toluene phase contains more than 95% of pure (3E,7E)-homofarnesylic acid.

Sequences:
SEQ ID NO: 1-326 Nucleic acid/amino acid sequences of various SHC genes
SEQ ID NO: 327-328 PCR primer
SEQ ID NO: 329, 330 Nucleic acid/amino acid sequences of lipase CALB It is explicitly referred to the references as cited herein.

SEQUENCE LISTING (330 sequences)

SEQ ID NO: 1 - DNA, 2178 bp, Zymomonas mobilis
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtctttacccgttattggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaattcctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 2 - protein, 725 aa, Zymomonas mobilis
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVFTRYWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKIPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAFMLRYDFYRQFFPIMALSRAERLIDLNN

SEQ ID NO: 3 - protein, 680 aa, Streptomyces coelicolor
MTATTDGSTGASLRPLAASASDTDITIPAAAAGVPEAAARATRRATDFLLAKQDAEGWWKGDLETNVTMDAEDLLLRQFLGIQDEETTRAAALFIRGEQREDGTWATFYGGPGELSTTIEAYVALRLAGDSPEAPHMARAAEWIRSRGGIASARVFTRIWLALFGWWKWDDLPELPPELIYFPTWVPLNIYDFGCWARQTIVPLTIVSAKRPVRPAPFPLDELHTDPARPNPPRPLAPVASWDGAFQRIDKALHAYRKVAPRRLRRAAMNSAARWIIERQENDGCWGGIQPPAVYSVIALYLLGYDLEHPVMRAGLESLDRFAVWREDGARMIEACQSPVWDTCLATIALADAGVPEDHPQLVKASDWMLGEQIVRPGDWSVKRPGLPPGGWAFEFHNDNYPDIDDTAEVVLALRRVRHHDPERVEKAIGRGVRWNLGMQSKNGAWGAFDVDNTSAFPNRLPFCDFGEVIDPPSADVTAHVVEMLAVEGLAHDPRTRRGIQWLLDAQETDGSWFGRWGVNYVYGTGSVIPALTAAGLPTSHPAIRRAVRWLESVQNEDGGWGEDLRSYRYVREWSGRGASTASQTGWALMALLAAGERDSKAVERGVAWLAATQREDGSWDEPYFTGTGFPWDFSINYNLYRQVFPLTALGRYVHGEPFAKKPRAADAPAEAAPAEVKGS

SEQ ID NO: 4 - protein, 720 aa, Acetobacter pasteurianus
MNMASRFSLKKILRSGSDTQGTNVNTLIQSGTSDIVRQKPAPQEPADLSALKAMGNSLTHTLSSACEWLMKQQKPDGHWVGSVGSNASMEAEWCLALWFLGLEDHPLRPRLGKALLEMQRPDGSWGTYYGAGSGDINATVESYAALRSLGYAEDDPAVSKAAAWIISKGGLKNVRVFTRYWLALIGEWPWEKTPNLPPEIIWFPDNFVFSIYNFAQWARATMMPLAILSARRPSRPLRPQDRLDALFPGGRANFDYELPTKEGRDVIADFFRLADKGLHWLQSSFLKRAPSREAAIKYVLEWIIWHQDADGGWGGIQPPWVYGLMALHGEGYQFHHPVMAKALDALNDPGWRHDKGDASWIQATNSPVWDTMLSLMALHDANAEERFTPEMDKALDWLLSRQVRVKGDWSVKLPNTEPGGWAFEYANDRYPDTDDTAVALIAIASCRNRPEWQAKGVEEAIGRGVRWLVAMQSSCGGWGAFDKDNNKSILAKIPFCDFGEALDPPSVDVTAHVLEAFGLLGLPRDLPCIQRGLAYIRKEQDPTGPWFGRWGVNYLYGTGAVLPALAALGEDMTQPYISKACDWLINCQQENGGWGESCASYMEVSSIGHGATTPSQTAWALMGLIAANRPQDYEAIAKGCRYLIDLQEEDGSWNEEEFTGTGFPGYGVGQTIKLDDPAISKRLMQGAELSRAFMLRYDLYRQLFPIIALSRASRLIKLGN

SEQ ID NO: 5 - protein, 684 aa, Bradyrhizobium sp.
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVFTRYWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKIPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGFPGYGVGQTIKLNDPALSQRLMQGPELSRAFMLRYGMYRHYFPLMALGRALRPQSHS

SEQ ID NO: 6 - protein, 658 aa, Zymomonas mobilis
MTVSTSSAFHHSSLSDDVEPIIQKATRALLEKQHQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAIQKAVAWLKNIQNEDGGWGENCDSYALDYSGYEPMDSTASQTAWALLGLMAVGEANSEAVTKGINWLAQNQDEEGLWKEDYYSGGGFPRVFYLRYHGYSKYFPLWALARYRNLKKANQPIVHYGM

SEQ ID NO: 7 - protein, 648 aa, Acidithiobacillus caldus
MNPVVHNLTRPHRSAEPRPSALQRSIAAAQAALLQHQAADGHWCFEFEADCTIPAEYILMMHYMDERDAALEAKMAAYLRRKQENHGGWSLYHGGHFDMSASVKAYFALKLAGDDPEAAHMRRARSAILAHGGAERANVFTRITLALFGQVPWRAVPFIPVEILLFPRWFPMHIYKVASWSRTVMVPLFILCSLKPQAKNPLGVHIRELFTRPPEDIDDYFAHALQGWVSRIFLWFDRLGRALESWIPQALRRRAIARAEAWFIERLNGEDGLNGIFPAMVNAHEALALLGYAAEHPYRQQTRAALTKLVVERAGEAYCQPCVSPVWDTCLALHALLEADGDVSEAARRSMQWLLDRQITDAPGDWRERRPHLAGGGWAFQYANPYYPDLDDTAAVAWALARARRPEDRPAVERAANWLAGMQSRNGGFGAYDVDNTYYYLNEIPFADHKALLDPPTADVSGRVLAFLAILDREQDAPVRARLIQYLLREQEPSGAWFGRWGTNYIYGTWSVLMGMAELRDPGAEVRDAMARAAHWLRSVQQDDGGWGESNDSYADPGLAGLGQESTAAQTAWACLALMAAGDSDSESLRRGIQWLQRHQEQPGDWQDPYFNAPGFPRVFYLTYHGYKIYFPLWALARYRNITERHCA

SEQ ID NO: 8 - protein, 643 aa, Acidithiobacillus ferrooxidans
MNRMLQPLHSGAGIFRSSLDRVIAQARQALGGRQAEDGHWCFEFEADCTIPAEYILMQHYMDERDEALEARIAVYLRGKQADHGGWPLYYGGHFDLSASVKVYYALKLAGDDPELPHMRRAREAILAHGGAERSNVFTRITLALFAQVPWRAVPFIPVEIMLLPRWFPFHIYKVASWSRTVMVPLFILCSLKARAKNPLQVHIRELFRRPPDQITDYFSHARRGIVAYIFLSLDRFWRLMEGWIPHGIRRRALKKAEAWFTARINGEDGLNGIFPAMVNAHEALELLGYPPDHDYRRQTGAALRKLVVERANDAYCQPCVSPVWDTCLALHALLEEDGEVSPAVQNGIRWLKNRQIGAEPGDWRESRPHLAGGGWAFQYANPYYPDLDDTAAVGWALARAGRAEDRDSIEKAANWLAGMQSRNGGFGAYDVDNTHYYLNEIPFADHKALLDPPTADVTGRVVAFLAHLARPRDRDVLRRAVAYLLREQESSGAWFGRWGTNYIYGTWSVLMALAELNDPSLKPTMERAAYWLRAVQQGDGGWGESNDSYSDPGLAGMGQTSTAAQTAWACLGLMAAGDRDSVALHRGIAWLQAHQEGDGCWQAPFFNAPGFPKVFYLIYHGYAFYFPLWALARYRNLGCMAHE

SEQ ID NO: 9 - protein, 679 aa, Acidobacterium capsulatum
MSVSERAQPGGNPIPGSTSQSAVKFGRIDAALEDVKRAIAGAKDRVFAQQSKDGWWCGELEADSMLEADYIFAHTLLGTGDAGKMKRALTEMLRYQNEDGSWSIYPGGPGNISLTVKCYFSAKLMGMTADNPILVKAREWILAHGGVVECNTFTKIYLCFLGQYEYDAVPAIPPEIVLFPNWFYFNIYEISSWSRAILVPLSIAYAKKPFKKIPPEQGIDELFVGGREKANLHLRWDSKNLLSWRNFFLALDRVTHWFERVHIRPLRSIALKKAEKWMLARFEMSDGLGAIYPAMLNAIIALRCLGYSLDDPQVLRAMDEFEKLGIDEPEGTAEYAEPTFRMQPCVSPVWDTAQAVFALGEAGVPRNDPRMQKAADWLLSKEVRHKGDWAMKVRNAQPGGWYFEFNNEFYPDVDDSAQVLLALNKVDNPRERYQYDVCQRAIDWIFAMQCRNGGWASFDKDNTKMIFQYVPFADHNAMLDPPTVDITGRILEMLATYGYTRKDRRVEKAIKFIYDEQEPDGSWFGRWGVNYLYGTFLVLRGLEAIGVWNHEPQIQQAAEWIRSVQNADGGWGETCGSYDDPNTRGVGPSTPSQTAWAILGLLSAGDDRSDSVAKGIKWLLAHQKPDGGWDESTGSGSKHQALYTGTGFPRVFYLAYHQYRDYFPLLALTNYEKAMERGE

SEQ ID NO: 10 - protein, 633 aa, Acidothermus cellulolyticus
MTQASVREDAKAALDRAVDYLLSLQDEKGFWKGELETNVTIEAEDLLLREFLGIRTPDITAETARWIRAKQRSDGTWATFYDGPPDLSTSVEAYVALKLAGDDPAAPHMEKAAAYIRGAGGVERTRVFTRLWLALFGLWPWDDLPTLPPEMIFLPSWFPLNIYDWGCWARQTVVPLTIVSALRPVRPIPLSIDEIRTGAPPPPRDPAWTIRGFFQRLDDLLRGYRRVADHGPARLFRRLAMRRAAEWIIARQEADGSWGGIQPPWVYSLIALHLLGYPLDHPVLRRGLDGLNGFTIREETADGAVRRLEACQSPVWDTALAVTALRDAGLPADHPRVQAAARWLVGEEVRVAGDWAVRRPGLPPGGWAFEFANDNYPDTDDTAEVVLALRRVRLEDADQQALEAAVRRATTWVIGMQSTDGGWGAFDADNTRELVLRLPFCDFGAVIDPPSADVTAHIVEMLAALGMRDHPATVAGVRWLLAHQEPDGSWFGRWGANHIYGTGAVVPALIAAGVSPDTPPIRRAIRWLEEHQNPDGGWGEDLRSYTDPALWVGRGVSTASQTAWALLALLAAGEEASPAVDRGVRWLVTTQQPDGGWDEPHYTGTGFPGDFYINYHLYRLVFPISALGRYVNR

SEQ ID NO: 11 - protein, 695 aa, Adiantum capillus-veneris
MLPYNQDHHFGKVAENATMPPTLDEAIERSQDFLLSLQYPEGYWWAELEANVTLTAQTIMLYKILGIDHKYPIHKMKTYILRTQRAHGGWEIFYGDGGCLSTTIGAYMALRILGVPKTDPVLQKALKLIHSKGGVTKSRMFTKICLALLGCYDWKGIPSLPPWLVLLPSWFPFSLYDTASWVRGCVVPLTIIFDKKPVYKLNPLLCLDELYSEGKGKARVHLSFIPGDWTSNFFVGLDHVFKYMENLGVVPFRQWGIKEAERWTLERHEDSGDFHGIYPPMFYSIVSYSLLGYEITDPVVHRALESMRGFTVEREDECVVQSCISPMWDTAFVIRSLAESGLQPDHPALQKAGEWLLQKQATQHGNWFYKKRTGRAGGWAFQFFNRWYPDVDDSAAVSMALNAIKLQDDDVKKGAIKRCAEWISVMQCKDGGWAAYDCDNDREWLNCTPFGDLKAMIDPNTVDVTARVLEMVGRVKEAGDASAILPPRAIARGLAYLRREQETEGCWYGRWGVNYIYGTSGALMALALVAPSTHKEEIERGARWLVEVQNKRGTKGANGYSHTNGAREGGVAMNGNCKNMGAPEDGGWGETCFSYNDITLKGRNEVSTVSQTAWALQGLLAAGDALGKYEVESIEHGVQYLLSTQRKDGSWCEKHFTGGGFPRFFYIRYHLYAGHFPLSALARYRDRVRAGKMAK

SEQ ID NO: 12 - protein, 740 aa, Ajellomyces capsulatus
MMYNNQWYFNQFNDIFCFPEQQKEYFPPTGTNISLNLKKRPDRQLLAHGASDLNGPFHLSQHNAFSAMLLAEVQKVLRLAVGHSLDLQRTDGAWCGEVHSNATFTAQYVFLQQQLGLPLDPTEIEGLSRWLFSQQNEDGSWGLGPGLGGDVSTTTETYLALKILGVSPEDPRMAAARSSIIKAGSLPATRMFTRVFLASFGLIPWSAVPPLPAELILLPTLFPVNIYNLSSWARATCVPLLLIRHHEPLHSLPNGRHAENDFLDELWTKDIPRDFCYTTPLSRMWRLGDYAGIFFTSADHGLRFLGQYFNSPLRNLSRRKIINWILDHQEQSGEWAGYWPPQHNNIWALSLEGYSLDHPVLRRGIAAVKSFVLHDVTGMRAQVTVSQVWDTALMSIALSDSAPSTGIISPTQAIDWLMHHEVASHRGDWRVLRPKLATGGFCFEEFNTLYPDVDDTAAVIMALIKSNPAHLISGCVRRAAQWILGMQNRDGGWGAFDWNNDKFFLNKIPFSDMDSLCDPSTPDVTGRIIECFGMMMAGRHGYSLDGPLESRLRASSQLAIAYLLGCQENNGSWWGRWGVNYLYGTSNVLCGLAYYYDRSGLSKGDGKSNSHIVSAVDRASEWLKARQHSNGGWGEGPESYDSAQLAGCGQPTASQSAWVTMALLNYLSPTDEVIQRGISYLVRSQVKYGDESRATWPLERYTATGFPGHLYMEYDYYRHYFPIMALGRYVNKLSESHKLL

SEQ ID NO: 13 - protein, 648 aa, Ajellomyces capsulatus
MAQMASSLGSPRLLLRMGREAAQQQHLASGTEVQKALRLAVGHSLDLQRTDGAWCGEVHSNATFTAQYVFLQQQIGLPLDPTEIEGLSRWLFSQQNEDGSWGLGPGLGGDVSTTTETYLALKILGVSPEDPRMAAARTSIIKAGSLPATRMFTRVFLASFGLIPWSAVPPLPAELILLPTLFPVNIYNLSSWARATCVPLLLIRHHEPLHSLPNGRHAENDFLDELWTKDIPRDFCYTTPLSRMWRLGDYAGIFFTSADHGFRFLGQYFNSPLRNLSRRKIINWILDHQEQSGEWAGYWPPQHNNIWALSLEGYSLDHPVLRRGIAAVKSFVLHDATGMRAQVTVSQVWDTALMSIALSDSAPSTGIISPTQAIDWLMHHEVASHRGDWRVLRPKLATGGFCFEEFNTLYPDVDDTAAVIMALIKSNPAHLISGCVRQCFGMMMAGRHGYSLDCQLETRLRASSQLAIAYLLGCQENNGSWWGRWGVNYLYGTSNVLCGLAYYYDRSSLSKGDGKSNSNIVSAVDRASEWLKARQHSNGGWGEGLESYDNAQLAGCGQPTASQSAWVTMALLNYLSPTDEVIQRGVSYLVRNQVKYGDESRATWPLERYTATGFPGHLYMEYDYYRHYFPIMALGRYVNKLSGSHKLL

SEQ ID NO: 14 - protein, 673 aa, Ajellomyces capsulatus
MLLAEVQKALRLAVGHSLDLQRADGAWCGEVHSNATFTSQYVFLQQQIGLPLDPTEIEGLSRWLFSQQNEDGSWGLGPGLGGDVSTTTETYLALKILGVSPEDPRMAAARTSIIKAGSLPATRMFTRVFLASFGLIPWSAVPPLPAELILLPTLFPVNIYNLSSWARATCVPLLLIRHHEPLHSLPNGRHAENDFLDELWTKDIPRDFCYTTPLSRMWRLGDYAGIFFTSADHGLRFLGQYFHSPLRNLSRRKIINWILDHQEQSGEWAGYWPPQHNNIWALSLEGYSLDHPVLRRGIAAVKSFVLHDATGMRAQVTVSQVWDTALMSIALSDSAPSTGIISPTQAIDWLMHHEVASHRGDWRVLRPKLATGGFCFEEFNTLYPDVDDTAAVIMALIKSNPAHLISGCVRRAAQWILGMQNRDGGWGAFDWNNDKFFLNKIPFSDMDSLCDPSTPDVTGRIIECFGMMMAGRHGYSLDCQLENRLRASSQLAIAYLLGCQENNGSWWGRWGVNYLYGTSNVLCGLAYYYDRSSLSKGDVKSNSNIVSAVDRASEWLKARQHSNGGWGEGPESYDNAQLAGCGQPTASQSAWVTMALLNYLSPTDEVIQRGVSYLVRNQVKYGDESRATWLLERYTATGFPGHLYMEYDYYRHYFPIMALGRYVNKLSGSHKLL

SEQ ID NO: 15 - protein, 631 aa, Alicyclobacillus acidocaldarius
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVAISIVMSRQPVFPLPERARVPELYDTDVPPRRRGAKGGGGRIFDALDRALHGYQKLSVHPFRRAAEIRALDWLLERQAGDGSWGGIQPPWFYTLIALKILDMTQHPAFIKGWEGLELYGVDLDYGGWMFQASISPVWDTGLAVLALRAAGLPADHDRLVKAGEWLLDRQITVPGDWAVKRPNLKPGGFAFQFDNVYYPDVDDTAVVVWALNSLRLPDERRRRDVMTKGFRWIVGMQSSNGGWGAYDVDNTSDLPNHIPFCDFGEVTDPPSEDVTAHVLECFGSFGYDDAWKVIRRAVEYLKREQRPDGSWFGRWGVNYLYGTGAVVPALKAVGIDVREPFIQKALDWVEQHQNPDGGWGEDCRSYEDPAYAGKGASTPSQTAWALMALIAGGRAESDSVRRGVQYLVETQRPDGGWDEPYYTGTGFPGDFYLGYTMYRHVFPTLALGRYKQAIERR

SEQ ID NO: 16 - protein, 631 aa, Alicyclobacillus acidocaldarius [sequence omitted]

SEQ ID NO: 17 - protein, 227 aa, Alicyclobacillus acidocaldarius
QASISPVWDTGLAVLALRAAGLPADHDRLVKAGEWLLDRQITVPGDWVVKRPNLNPGGFALQFDNVYYPDVDDTAVVIWALNTLRLPDERRRRDAMTKGFRWIVGMQSSNGGWGAYDVDNTSDLPNHIPFCDFGEVTDPPSEDVTAHVLECFGSFGYDDAWKVIQRAVAYLKREQKPDGSWFGRWGVNYIYGTGAVVSALKAVGIDMREPYIQKALDWVEQHQNPDG

SEQ ID NO: 18 - protein, 634 aa, Alicyclobacillus acidoterrestris
MTKQLLDTPMVQATLEAGVAHLLRRQAPDGYWWAPLLSNVCMEAEYVLLCHCLGKKNPEREAQIRKYIISQRREDGTWSIYPGGPSDLNATVEAYVALKYLGEPASDPQMVQAKEFIQNEGGIESTRVFTRLWLAMVGQYPWDKLPVIPPEIMHLPKSVPLNIYDFASWARATIVTLSYRHESPTCDATSGLCKGSGIVRGEGPPKRRSAKGGDSGFFVALDKFLKAYNKWPIQPGRKSGEQKALEWILAHQEADGCWGGIQPPWFYALLALKCLNMTDHPAFVKGFEGLEAYGVHTSDGGWMFQASISPIWDTGLTVLALRSAGLPPDHPALIKAGEWLVSKQILKDGDWKVRRRKAKPGGWAFEFHCENYPDVDDTAMVVLALNGIQLPDEGKRRDALTRGFRWLREMQSSNGGWGAYDVDNTRQLTKSDSIFATSGEVIDPPSEDVTAHVLECFGSFGYDEAWKVIRKAVEYLKAQQRPDGSWFGRWGVNYVYGIGAVVPGLKAVGVDMREPWVQKSLDWLVEHQNEDGGWGEDCRSYDDPRLAGQGVSTPSQTAWALMALIAGGRVESDAVLRGVTYLHDTQRADGGWDEEVYTGTGFPGDFYLAYTMYRDILPVWALGRYQEAMQRIRG

SEQ ID NO: 19 - protein, 236 aa, Alicyclobacillus acidoterrestris
GGWMFQASISPIWDTGLTVLALRSAGLPPDHPALIKAGEWLVSKQILKDGDWKVRRRKAKPGGWAFEFHCENYPDVDDTAMVVLALNGIQLPDEGKRRDALTRGFRWLREMQSSNGGWGAYDVDNTRQLTNRIPFCNFGEVIDPPSEDVTAHVLECFGSFGYDEAWKVIRKAVEYLKAQQRPDGSWFGRWGVNYVYGIGAVVPGLKAVGVDMREPWVQKSLDWLVEHQNEDGGWGE

SEQ ID NO: 20 - protein, 637 aa, Anabaena variabilis
MRTQDRVQVNSIAEAIAASQKYLLSLQNPTGYWWAELESNVTITAEVVLLHKIWGTDKTRPLHKIEAYLRSQQKQHGGWELFYGDGGELSTSVEAYMALKLLGVPATDPAMIQARDFILQRGGISKTRIFTKFHLALIGCYNWRGLPSLPAWVMLLPNQFPVNIYEMSSWARSSTVPLLIVFDQKPVYQVNPAITLDELYAEGVENVRYELPRSGDWTDLFLTLDEGFKLAESFNFIPFREEGIKAAEKWIIERQEATGDWGGIIPAMLNSMLALRVLGYATNDPIVERGLQAIDNFAIETADCYRVQPCVSPVWDTAWVIRALIDSGMAPDHPAIVKAGEWLLQKQIFDYGDWNVKNRQGQPGAWAFEFDNRFYPDVDDTAVVVMALHAAKLPHEQLKQKACDRALQWVASMQCKPGGWAAFDIDNDQDWLNAVPYGDLKAMIDPNTADVTARVIEMLGACNLSIDSHDLERALTYLLNEQEAEGCWFGRWGVNYIYGTSGVLCALALINPQKYQRHIQQGATWLVGCQNPDGGWGETCFSYNDPSLKGQGDSTPSQTAWALIGLIAAGEATGNFAHDVIERGINHLVSTQQPDGSWFEAYFTGTGFPCHFYLKYHYYQQYFPLIALGRYQAINPL

SEQ ID NO: 21 - protein, 654 aa, Anaeromyxobacter sp.
MSGEVRVAGDALAEDAGRAAAAASQYLYRTQQRDHWRAELESNVTVTAEYVLLRQALGLDLEERRDALVRYLCSRQKADGSFGIASTLPGDVSTTAEAYLALRLLGLDREDERLRAAERFIRGAGGLARVRVFTRINLALFGLFPWEAVPTVPAELIFLPRWAPVNVYRLASWARSTMVPLFVLFHHRPVFALPGGAGSDWLDHLWLGPGDKRVPYRTSVMETVRRHGPGWKAFFNAADAWLRVHDRLRHLPPLGRLRTEALRACEEWILARQEASGDWAGIFPPMLNGVLALHVAGHGLDAAPVRRGLEAIERFAVSDREGFRIEACQSPVWDTILALIGLLDSGESPTDPRLVAARRWIEGMQLTNDWGDWKVYDPRGEPGGWAFEYANSWYPDVDDTAAVIVGLLKHDPASRAGETVRRAAAWVASMQNRDGGWAAFDVNNDRLFLNEIPFSDMDSLCDPSSPDVTGRVLEAFGMLDAPHLRAACRRGVAYLRRAQEPEGSWYGRWGVNYVYGTSNVLNGLARQRVPASDPMVARALGWLDSVQNADGGFGEGLESYADRAAMGRGPSTASQTAWGVMGLLAYRAADDAAVRRGIAWLVERQLADGEAQGSWEEEAFTGTGFPRHFYLRYHLYRHYFPLMALGRFCAQGRG

SEQ ID NO: 22 - protein, 710 aa, Aspergillus clavatus
MATLTTMATTATMATTEASQPLEAQARTALTKATSYAWEIISNRHWCGELESNVTVTCEHIFFLYVLYQHIDPDEGSQYRQWLLSQQNADGSWGIAPNYPGDVSTSAEAYLALRIIGMSPDSPELFQARTFIRAAGGLSKMRMFTRIFFAEFGLVPWTAIPQLPAEFILVPAHFPISIYRLASWARSNVVPLLIIAHHRPLYPLPNGLHKQNPFLDELWLDPATKPLPYGSLDPTDPLSFVFTILDKALSYLGGLRRCPTRGYARRRCIQWILQHQEKAGDWAGIIPPMHAGIKALWLEGYKLHDEPIQLGLAAIERFTWTDNRGKRLQCCISPVWDTVLMIRALQDTPASLGIKSDPRIADALAWTAENQHRGPEGDWRVYQPNIPVGGWAFEYSNTWYPDIDDTAAAVLAFLTHDPATARSRLVRDAVLWIVGMQNADGGWAAFDHENNRLFLNKIPFSDMESLCDPSTPDVTGRTIECLGMLRDLLMLPAEKAGKKGEKYGYPDGERDAAADSHLLKIINTACARAIPYLIRTQEATGAWYGRWAVNYVYGTCLVLCGLQYFKHDPTFAPEIDTMATRAVKWLRQIQNSDGGWGESVLSYREPWRAGCGPSTPSQTAWALMGLLTVCGGEDRSVQRGVRHLVDTQDDILSKGEGGAAAWTEREFTSTGFPNHFYISYTLYRVYFPITALGRYLSLVEGGKKENGGGA

SEQ ID NO: 23 - protein, 673 aa, Aspergillus flavus
MTTGHRQFDDGLSERERLIHEAGLTLQRSMDYAYNVVRSDGHWCGEMSSNVTITAEYIFLRQALGLDLKTDGAAYCRHILSQQNSDGSWGLAPEYPGDVSTTTEAYLALKMLGLSTDAPAMQQAKAFVLNAGGVAKVRVFTRIFLATFGLFPWKAVPQLPVELILLPSACPINIYKFASWARGTIAPLLIICHHQPVYALPNGVFAENEYLDELWQDPTNKSEPYSPSIWELLSQGDITGLTFSLLDKLLYQLNGLRSIPLLRSYALKQCMKWILERQEPTGDWAGIFPPMHASVYAFVLEGYKLEDPPVRLGIEALENFAWEDAKGKRVQPCVSPVWDTTLMSIALSDAATPNHQIVDRAIQWIRDRQLLEPRGDWRVYRPRLAPGGFSFEYTNSHYPDIDDSAAIILAQVKHDPISANSSSVIAAATWILGMQNPDGGWAAFDVENDKLFLNKIPFSDMDSLCDTSCADITGRILEAFGLLIRRVPDKDSSQLFQLLPAIRAACRRGIRYLASTQEANGAWFGRWGCNYIYGTSHALCGLAYFLQEDQQVPAMVQPALQWLKSQQNDDGGWGESLLSYQSPERKEQRSTASQTAWALMGLLAHLPHTDIVIERGIRWLVSSQRPVETLGSTWPEPVYTGTGFPNHFYLGYDYYRHYFPMMALGRYLRGVQG

SEQ ID NO: 24 - protein, 738 aa, Aspergillus fumigatus
MLGAIREPPIDVQIALHSRDDNQTGLVLRGTRRTVDRVLKGLCSSPCFFCSVSLTMATLTTTMATTATMATTEASKPLEAQARTALTKATNYAWEIFSNRHWCGELESNVTVTCEHIFFLYVLYQHIDPGEGSQYRQWLLSQQNSDGSWGIAPNYPGDISTSAEAYLALRIIGMSTDSPELYRARTFIRAAGGLSKMRMFTRIFFAEFGLVPWTAIPQLPAEFILVPAHFPISIYRLASWARSNVVPLLIIAHHRPLYPLPNGLHKQNPFLDELWLDPATKPLPYGSSDPTDPVAFVFTILDKALSYLGGLRRSPTRGYARRRCVQWILQHQEKAGDWAGIIPPMHAGIKALLLEGYKLHDEPIQLGLAAIERFTWADNRGKRLQCCISPVWDTVLMIRALQDTPASLGIKLDPRIADALAWTAENQHRGPEGDWRVYKPNIPVGGWAFEYHNTWYPDIDDTAAAVLAFLTHDPATARSRLVRDAVLWIVGMQNADGGWAAFDHENNQLFLNKIPFSDMESLCDPSTPDVTGRTIECLGMLRDLLMRPAENAENGEKYGYPDGEGDAAADAHLLQIINTACARAIPYLIRSQEATGTWYGRWAVNYVYGTCLVLCGLQYFKHDPKFAPEIQAMAARAVKWLKQVQNSDGGWGESLLSYREPWRAGCGPSTPSQTAWALMGILTVCGGEDRSVQRGVRHLVDTQDDTLSQGDGGAAAWTEREFTIREPLHEASQRIGSD

SEQ ID NO: 25 - protein, 689 aa, Aspergillus fumigatus
MLQTEAITTEGLRVRSLSPDDPLLPRIKQAIKLSGQHSRGEMHSDGHWCGEVKTNATTSAEHVLLCQALGINLDADREAFISWFRCTQGADGGWSTAPDQAGDISVTVEAYLALKILGLSEDDAAMRRARDFAIAAGGVAKVRIFTRIYLALFGLFPWAAVPELPPELILLPSRVPVSIYHWSAWARATVVPLLIISHHRPIYALPGGGKGTSSDYLDELWCDPQNKMIPYNHDEPTAWRSDPFASIFTLADSILHRLDGLRSFNPFRRFALQKCVDWILEHQEDMGDIGDIMPPLHGAMLALRLEGYPLHSGPIHRGLEAIERFAYRDKQGKRIQTTVSAFWDTSLMLIALGDAGMASKPWLTRSLGWLQQHQRLGNYGDWKVNNHGLKAGGFSFGYFNTWYPDVDDTASAVLAMIRQDERLVHSASVLDALNWLLGMQNTDGGWGAFDRDNDKHFLNKIPFSDMDALCDPSTPDVTGHVLEAFGLFLALSKADALADRVVAASRRAIRYLSDTHVLSRGWYGRWGCNYIYGTSAVLCALAYFGSENDALSGVRVMKDAINQAIRWLETVQNPDGGWGETVDSYKDPSRAGSGPSTASQTAWAIMALLPYLPPSTEVIQRGMEYLLRTQTKTASQGATWHEKAYTATGFPKYFYMGYSLYAHYFPMMALGRYAYPCPAWHENWRLKRD

SEQ ID NO: 26 - protein, 671 aa, Aspergillus fumigatus
MATLTTTMATTATMATTEASKPLEAQARTALTKATNYAWEIFSNRHWCGELESNVTVTCEHIFFLYVLYQHIDPGEGSQYRQWLLLQQNSDGSWGIAPNYPGDISTSAEAYLALRIIGMSTDSPELYRARTFIRAAGGLSKMRMFTRIFFAEFGLVPWTAIPQLPAEFILVPAHFPISIYRLASWARSNVVPLLIIAHHRPLYPLPNGLHKQNPFLDELWLDPATKPLPYGSSDPTDPVAFVFTILDKALSYLGGLRRSPTRGYARRRCVQWILQHQEKAGDWAGIIPPMHAGIKALLLEGYKLHDEPIQLGLAAIERFTWADNRGKRLQCCISPVWDTRVYKPNIPVGGWAFEYHNTWYPDIDDTAAAVLAFLTHDPATARSRLVRDAVLWIVGMQNADGGWAAFDHENNQLFLNKIPFSDMESLCDPSTPDVTGRTIECLGMLRDLLMRPAENAENGEKYGYPDGEGDAAADAHLLQIINTACARAIPYLIRSQEATGTWYGRWAVNYVYGTCLVLCGLQYFKHDPKFAPEIQAMAARAVKWLKQVQNSDGGWGESLLSYREPWRAGCGPSTPSQTAWALMGILTVCGGEDRSVQRGVRHLVDTQDDTLSQGDGGAAAWTEREFTSTGFPNHFYISYTLYRVYFPITALGRYLSLIEGGQEKKKKGGGT

SEQ ID NO: 27 - protein, 693 aa, Aspergillus niger
MAHQETMASETSISLHTLACDATKLAGTYALRQVREDGHWYGEMKSNATITAEYVFLAQALGFSIEEDRDDLIKYFLSEQNTDGSWSLAYDFPGDVSVTAEAYFALCLLGLDRSHPAMASAREFTLSKGGIAKVRVFTRMFFACFGLFPWSAVPELPAELILLPAAAPMSIYQLASWARATVVPMLVIRHHRPIYALPNGRSSSNEYLDELWVDPTDKMVPYSPSLWSLWNDDLTAFGFTLADNILKALGGLRWFPSRKIALRHCVAWILERQEPEGDIGGIFPPLHAALFALALEGYGLESSPVRRGIDALQNTYAWRDSTGLRIQGCISPILDTILMTIGLIDSSLPAESPLVARSSRYLKAHQQLGNEGDWRVYNGNVPSGGFNFEYFNSWYPDIDDTAAAILAMVKQDPNLLDLGPILSAVQWILGLQNDDGGWAAFDRENNYLFLNKIPFSDMDSFCDPSTADVTGRVIECFGLNGKNPIPRFFIDDMSSATERAIDFLSTEQEADGSWYGRWGSNYIYGTSAVLCGLVYHLEGWDDTYPVMEKRHKVDTHAALDWLKRHQNPDGGWGERLESYYEPRLAGNGPSTASQTAWALMGLLAYLAPTDESITRGIQYLSRTQIKEGELAGSWKEDHYTGTGFPNHFYLCYTLYSQYFPMMALGRYTSLSGYRPLENLESTVEDHKGNSSDC

SEQ ID NO: 28 - protein, 653 aa, Aspergillus niger
MMTLREEGHKEGITPGKEQLTSDIEHSLKLATEYALSSIRSDGHWCGELRSNVTITAEYIFLRHALGLDLRTDNAAYCRYILSQQNCDGSWGLAPEYPGDVSTTTEAYLALKLLGTSPDMPAMQQARAFVRKAGGAEKVRVFTRIFLATFGLFPWDAVPQLPVELILLPSSCPINMYTLASWARGTIAPLLIICHHQPVYALPEDYLDELWLDPTDKNVPYGSSLRDLLSRGDITGLAFSVVDNLLYYLNGLRSVPLLRSYARRKCIQWILERQEPTGDWAGIFPPMHASIYAFVLEGYELNDPPVRLGIQALENFAWEDEKGKRIQACVSPVWDTALMSIGLCDAMSPDKQILQQAITWIRNRQLLKPCGDWRIYRSKLAPGGFSFEYENSHYPDVDDTAAIILAQLKQDPQSVASDSVIAAATWILGMQNPDGGWAAFDVENDKLFLNKIPFSDMDSLCDTSCADITGRILEAFGLMMKRELKRPVLSPMLRHACIRGITYLASTQESNGAWFGRWGCNYIYGTCHALGLVAPALQWLKSKQNDDGGWGEPLLSYRTPGTQLQQQSTPSQTAWALMGLLAHLPLTDPAIERGIRWLVCSQQPEKGNGASWPEAVYTGTGFPNHFYLGYDYYRHYFPMMALGRYLQASQAQA

SEQ ID NO: 29 - protein, 673 aa, Aspergillus oryzae
MTTGHRQFDDGLSERERLIHEAGLTLQRSMDYAYNVVRSDGHWCGEMSSNVTITAEYIFLRQALGLDLKTDGAAYCRHILSQQNSDGSWGLAPEYPGDVSTTTEAYLALKMLGLSTDAPAMQQAKAFVLNAGGVAKVRVFTRIFLATFGLFPWKAVPQLPVELILLPSACPINIYKFASWARGTIAPLLIICHHQPVYALPNGVFAENEYLDELWQDSTNKSEPYSPSIWELLSQGDITGLTFSLLDKLLYQLNGLRSIPLLRSYALKQCMKWILERQEPTGDWAGIFPPMHASVYAFVLEGYKLEDPPVRLGIEALENFAWEDAKGKRVQPCVSPVWDTTLMSIALSDAATPNHQIVDRAIQWIRDRQLLEPRGDWRVYRPRLAPGGFSFEYTNSHYPDIDDSAAIILAQVKHDPISANSSSVIAAATWILGMQNPDGGWAAFDVENDKLFLNKIPFSDMDSLCDTSCADITGRILEAFGLLIRRVPDKDSSQLFQLLPAIRAACRRGIRYLASTQEANGAWFGRWGCNYIYGTSHALCGLAYFLQEDQQVPAMVQPALQWLKSQQNDDGGWGESLLSYQSPERKEQRSTASQTAWALMGLLAHLPHTDIVIERGIRWLVSSQRPVETLGSTWPEPVYTGTGFPNHFYLGYDYYRHYFPMMALGRYLRGVQG

SEQ ID NO: 30 - protein, 659 aa, Azotobacter vinelandii
MERSSLLVPASIDSHSRESETTGLDQAIVRARAALLGRQGADGHWCFELESDCTITAEYILMMHFTDEIDEDLQERMARYLRATQVQETHGGWPQYVGGAIDLSCTVKAYYALKAAGDSPEAPHMRRAREAVLALGGAAKSNVFTRILLAMFEQVPWRAVPYLPVEIMLLPRWAPIHIEKMSYWARTTLVPLTILCSLKARAANPKRVDIRELFVTAPEQERHYFLRGGLLNRIFLGLDKFARTLDRWMPKSLRQHAIRKAEAWFLPRMNGEDGLGAIFPPMVNCYEAMILLGYPKDHPARKTCLRSIQKLIVHRDDGSAYCQPCVSPVWDTAWSAMALIHSGDDTATQTAIARAGDWLVQRQELDCRGDWEAQAPQAAPGGWAFQYANGYYPDIDDTALVAALLHISDRRRGQPGQHAFNIDRAVDWMLALQSRNGGFAAFDADNTHYYLNAIPFADHGALLDPPTEDVSGRVAACLGILKRDQDRDGLRRCIDYLRTTQQPDGSWWGRWGSNYIYGTWSALSGLALAGEDLRQPYLRKSVDWLRTRQHPDGGWGETNDSYIDPHLAGTNAGISTPHSTAWAVLAQLAMGEVESDSVRRGIAFLLACQQTDGLWSHPSHNAPGFPRVYYLKYHGYAAYFPLYALARYRHLLNRSREQR

SEQ ID NO: 31 - protein, 627 aa, Bacillus amyloliquefaciens
MSTIHENVRSRQKKTISLLRETQNADGSWSFCFEGPILTNAFLILLLTSLGDNDKELIAELAEGIRAKQRPDGTFANYPDDRKGNVTATVQGYAGLLASGLYSRSEAHMIQAERFIISNGGLRNVHFMTKWMLAANGLYPWPALHLPLSFLVIPPTFPLHFYQFSTYARIHFVPMAVTLNKRFSLKNPNVSSLAHLDRHMTKNPFTWLRSDQDENRDLSSLFAHWKRLLQIPAAFHQLGLRTAKTYMLDRIEEDGTLYSYASATIFMVYGLLALGVSRHSPVLRKALAGTKALLTSCGNIPYLENSTSTVWDTALLNYALMKSGISDNDQMITSAARFLRERQQKKVADWAVHNPHAEPGGWGFSNINTNNPDCDDTAAVLKAIPRKLYPASWERGLSWLLSMQNSDGGFSAFEKNVNHPLVRLLPLESAEEAAIDPSTSDLTGRVLHCLGEAGLSSDHPQIEKAVQWLIRHQEEDGSWYGRWGVCYIYGTWAALTGMKACGVSQNHPAVKKAIRWLKSIQNEDGSWGESCKSAEEKTYVPLSYGTLVQTAWAAEALLQYEKTHHQAVTKGISFLIENRHYEGAAFSYPTGIGLPKQFYIRYHSYPYVFSLLALSTFMKMSEKEEEK

SEQ ID NO: 32 - protein, 617 aa, Bacillus anthracis
MLLYEKAHEEIVRRATALQTMQWQDGTWRFCFEGAPLTDCHMIFLLKLLGRDKEIEPFVERVASLQTNEGTWKLHEDEVGGNLSATIQSYAALLASKKYTKEDANMKRAENFIQERGGVARAHFMTKFLLAIHGEYEYPSLFHLPTPIMFLQNDSPFSIFELSSSARIHLIPMMLCLNKRFRVGKKLLPNLNHIAGGGGEWFREDRSPVFQTLLSDVKQIISYPLSLHHKGYEEIERFMKERIDENGTLYSYATASFYMIYALLALGHSLQSSMIQKAIAGITSYIWKMERGNHLQNSPSTVWDTALLSYALQEAQVSKDNKMIQNATAYLLKKQHTKKADWSVHAPALTPGGWGFSDVNTTIPDIDDTTAVLRALARSRGNKNIDNAWKKGGNWIKGLQNNDGGWGAFEKGVTSKLLAKLPIENASDMITDPSTPDITGRVLEFFGTYAQNELPEKQIQRAINWLMNVQEENGSWYGKWGICYLYGTWAVMTGLRSLGIPSSNPSLTRAASWLEHIQHEDGGWGESCHSSVEKRFVTLPFSTPSQTAWALDALISYYDTETPAIRKGVSYLLSNPYVNERYPTGTGLPGAFYIRYHSYAHIYPLLTLAHYIKKYRK

SEQ ID NO: 33 - protein, 631 aa, Bacillus cereus
MNIVIRISKGWVSNLLLYEKVHEEIARRTTALQTMQRQDGTWQFCFEGAPLTDCHMIFLLKLLGRDKEIEPFVKRLASLQTNEGTWKLYEDEVGGNLSATIQSYAALLASKKYTKEDANMKRAEMFINERGGVARAHFMTKFLLAIHGEYEYPSLFHLPTPIMFLQNDSPLSIFELSSSARIHLIPMMVCLNKRFQVGKKLLPNLNHIAGGGGEWFREDRSPMFQTLLSDVKQIISYPLSLHHKGYEEVERFMKERIDENGTLYSYATASFYMIYALLALGHSLQSSMIQKAIAGITSYIWKMEKGNHLQNSPSTVWDTALLSYTLQEAHASKDNKMIQHAAAYVLKKQHTKKADWSVHAPGLIPGGWGFSDVNTTIPDVDDTTAVLRALARSRGNENVDNAWKKGVNWVKGLQNNDGGWGAFEKGVTSNLLANLPIENASDMITDPSTPDITGRVLELFGTYAQNELPEKQKQSAINWLMNVQEENGSWYGKWGICYIYGTWAVMTGLRSLGIPSSNPSMKRAALWLEHIQHEDGGWGESCQSSVEKRFITLPFSTPSQTAWALDALISYHDEETPAIRKGISYLLANPYVNEKYPTGTGLPGGFYIHYHSYAYIYPLLTLAHYIKKYRK

SEQ ID NO: 34 - protein, 631 aa, Bacillus cereus
MNIVIRISKGWVSNLLLYEKVHEEIARRTTALQSMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSLQSSMIQKAIAGITSYMWKMESGNHVQNSPSTVWDTALLSYALQEAHVLKDNKMLQNATAYLLKKQHTKKADWSVHAPALTPGGWGFSDVNTTVPDVDDTTAVLRVLARSRGNEKVDHAWQKGINWVKGLQNNDGGWGAFEKGVTSHILANLPIENASDMITDPSTPDITGRVLEFFGTYAQNELPEKQKQSAINWLMNVQEENGSWYGKWGICYIYGTWAVLTGLRSLGIPSSDPSLKRAALWLEHIQHEDGGWGESCQSSVEKRFVTLPFSTPSQTAWALDALISYYDKETSVIRKGISYLLSNPYINETYPTGTGLPGGFYIRYHSYAHIYPLLTLAHYAKKYRK

SEQ ID NO: 35 - protein, 620 aa, Bacillus cereus
MSNLLLYEKAHEEIVRRATALQTMQWQDGTWRFCFEGAPLTDCHMIFLLKLLGRDKEIEPFVERVASLQTNEGTWKLYEDEVGGNLSATIQSYAALLASKKYTKEDANMKRAENFIQERGGVARAHFMTKFLLAIHGEYEYPSLFHLPTPIMFLQDDAPFSIFELSSSARIHLIPMMLCLNKRFRVGKKLLPNLNHIAGGGGEWFREDRSPVFQTLLSDVKQIISYPLSLHHKGYEEIERFMKERIDENGTLYSYATASFYMIYALLALGHSLQSSMIQKAIAGITSYIWKMERGNHLQNSPSTVWDTALLSYALQEAQVSKDNKMIQNATAYLLKKQHTKKADWSVHAPALTPGGWGFSDVNTTIPDIDDTTAVLRALARSRGNKNIDNAWKKGGNWIKGLQNNDGGWGAFEKGVTSKLLAKLPIENASDMITDPSTPDITGRVLEFFGTYAQNELPEKQIQRAINWLMNVQEENGSWYGKWGICYIYGTWAVMTGLRSLGIPSSNPSLKRAASWLEHIQHEDGGWGESCHSSVEKRFVTLPFSTPSQTAWALDALISYYDTETPAIRKGVSYLLLNPYVNERYPTGTGLPGAFYIRYHSYAHIYPLLTLAHYLKKYRK

SEQ ID NO: 36 - protein, 620 aa, Bacillus cereus
MSNLLLYEKVHEEIARRATALQTMQRQDGTWRFCFEGAPLTDCHMIFLLKLLGRDKEIEPFVKRLASLQTNEGTWKLYEDEVGGNLSATIQSYAALLASQKYTKEDANMKRAENFIKERGGVARAHFMTKFLLAIHGEYEYPSLFHVPTPIMFLQNDSPLSIFELSSSARIHLIPMMVCLNKRFRVGKKLLPNLNHIAGGGGEWFREDRSPLFQTLLSDVKQIISYPLSLHHKGYEEVERFMKERIDENGTLYSYATASFYMIYALLALGHSLQSSMIQKAIAGITSYIWKMERGSHLQNSPSTVWDTALLSYALQEAQVPKDHKMIQQTITYLLKKQHTKKADWSVHAPALTPGGWGFSDVNTTVPDVDDTTAVLRVLARSRENEKVNNAWQKGIDWVKGLQNNDGGWGAFEKGVTSKLLANLPIENASDMITDPSTPDITGRVLELFGTYTQNELPEKQKQSAINWLMNAQEENGSWYGKWGICYIYGTWAVMTGLRSLGIPSNNPSLKRAALWLEHIQHEDGGWGESCQSSMEKRFITLPFSTPSQTAWALDALISYYDTETPAIRKGISYLLANPYVNEKYPTGTGLPGGFYIRYHSYAQIYPLLTLAHYTKKYRK

SEQ ID NO: 37 - protein, 620 aa, Bacillus cereus
MSNLLLYEKAHEEIARRATALQTMQREDGTWRFCFEGAPLTDCHMIFLLKLLGRDKEIEPFVKRLASLQTNEGTWKLYEDEVGGNLSATIQSYAALLASGKYTKEDANMKRAENFIKERGGVARAHFMTKFLLAIHGEYEYPSLFHVPTPIMFLQNDSPLSIFELSSSARIHLIPMMLCLNKRFRVGKKLLPNLNHIAGGGGEWFREERSPLFQTLLSDVKQIISYPLSLHHKGYEEVERFMKERIDENGTLYSYATASFYMIYALLALGHSLQSSMIQKAIAGITSYIWKMESGNHVQNSPSTVWDTALLSYALQEAHVPKDNKMLQNATAYLLKKQHTKKADWSVHAPALTPGGWGFSDVNTTVPDVDDTTAVLRVLARSKGNEKLDHAWQKGINWVKGLQNNDGGWGAFEKGVTSRILANLPIENASDMITDPSTPDITGRVLEFFGTYAQNELPEKQKQSAINWLMNAQEENGSWYGKWGICYIYGTWAVMTGLRSFGIPSSNPSLKRAALWLEHIQHKDGGWGESCHSSVEKRFVTLPFSTPSQTAWALDALISYYDTETPVIRKGISYLLANPYVNEKYPTGTGLPGGFYIRYHSYAHIYPLLTLTHYIKKYRK

SEQ ID NO: 38 - protein, 620 aa, Bacillus cereus
MSNLLLYEKAHEEIARRATALQSMQWQDGTWRFCFEGAPLTDCHMIFLLKLLGRDKEIEPFVKRLASLQTNEGTWKLYEDEVGGNLSATIQSYAALLASGKYTKEDANMKRAENFIKERGGVARAHFMTKFLLAVHGEYEYPSLFHLPTPIMFLQNDSPLSIFELSSSARIHLIPMMLCLNKRFRVGKKLLPNLNHIAGGGGEWFREERSPLFQTLVSDVKQIISYPLSLHHKGYEEVERFMKERIDENGTLYSYATASFYMIYALLALGHSLQSSIIQNAITGITSYIWKMESGNHLQNSPSTVWDTALLSYALQEAHVPKDNKMLQNATAYLLKKQHTKKADWSVHASALTPGGWGFSDVNTTVPDVDDTTAVLRVLARSRGNEKVDHAWQKGINWVKGLQNNDGGWGAFEKGVTSNILAKLPIENASDMITDPSTPDITGRVLEFFGTYAQNELPEKQKQSAINWLMNVQEENGSWYGKWGICYIYGTWAVMTGLRSFGIPSSNPSLKRAALWLEHIQHKDGGWGESCHSSVEKRFVTLPFSTPSQTAWALDALISYYDTETPIIRKGISYLLANPYVNEKYPTGTGLPGGFYIRYHSYAHIYPLLTLAHYIKKYRK

SEQ ID NO: 39 - protein, 620 aa, Bacillus cereus
MNNLLLYEKVHEEIARRATALQTMQQQDGTWRFCFEGAPLTDCHMIFLLKLLGRDKEIEPFVKRLASLQTNEGTWKLYEDEVGGNLSATIQSYAALLASKKYTKEDANMKRAENFIKERGGVARAHFMTKFLLAIHGEYEYPSLFHLPTPIMFLQNDSHLSIFELSSSARIHLIPMMLCLNKRFRVGKKLLPSLNHIAGGGGEWFREDRSPLFQTLVSDVKQIISYPLSLHHKGYEEVERFMKERIDENGTLYSYATASFYMIYALLALGHSLQSTMIQKAITGITSYIWKMESGNHLQNSPSTVWDTALLSYALQEAHVPKDNKMIQHAATYLLKKQHTQKADWSVHAPALTPGGWGFSDVNTTIPDVDDTTAVLRALARSRGNEKVDNAWPKGINWVKGLQNNDGGWGAFEKGVTSNILANLPIENASDMITDPSTPDITGRVLEFFGKYAQNELPEKQKQSAINWLMNVQEENGSWYGKWGICYIYGTWAVMTGLRSLGIPSSNPSMKRAALWLEHIQHEDGGWGESCHSSVEKRFVTLPFSTPSQTAWALDALISYYDKETSIIRKGISYLLANPYVNEKYPTGTGLPGGFYIRYHSYAHIYPLLTLAHYIKKYRK

SEQ ID NO: 40 - protein, 620 aa, Bacillus cereus
MSNLLLYEKVHEEIARRTTALQTMQRRDGTWRFCFEGAPLTDCHMIFLLKLLGRDKEIEPFVKRLASLQTNEGTWKLYEDEVGGNLSATIQSYAALLASKKYTKEDANMKRAEMFINERGGVARAHFMTKFLLAVHGEYEYPSLFHLPTPIMFLQSDSPLSIFELSSSARIHLIPMMLCLNKKFRIRKKLLPNLNHISGGGGEWFRGNRSPLFQTLVSDVKQIISYPLSLHHKGNEEVERFMKERIDENGTLYSYATASFYMIYALLALGHSLQSTMIQKAITGITSYIWNMESGNHLQNSPSTVWDTALLSYALQEAHVPKDTNMLQHATAYLLKKQHTKKADWSVHAPALAPGGWGFSDVNTTIPDVDDTTAVLRALARSRGSEKVDYVWEKGINWVKGLQNNDGGWGAFEKGVTSNLLANLPIENASDMITDPSTPDITGRVLELFGTYAQNELPEKQTQSAINWLMNVQEKNGSWYGKWGICYIYGTWAVMTGLRSLGIPSSNPSLKRAALWLEHIQHEDGGWGESCHSSVEKRFVTLPFSTPSQTAWALDALISYYDKETPAIRKGISYLLANRYVNEKYPTGTGLPGGFYICYHSYAHIYPLLTLAHYIKKYRK

SEQ ID NO: 41 - protein, 620 aa, Bacillus cereus
MSNLLLYEKVHEEIARRTTALQTMQRQDGTWQFCFEGAPLTDCHMIFLLKLLGRDKEIEPFVKRLASLQTNEGTWKLYEDEMGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSIQSPIIQKAITGITSYIWKMERGSHLQNSPSTVWDTALLSYVLQEAQVPKASKVIHNASAYLLRKQQTKKVDWSVHAPDLFPGGWGFSDVNTTIPDIDDTTAALRALARSRGNENVDTAWKRAVNWVKGLQNNDGGWGTFEKGVTSRILANLPIENASDMITDPSTPDITGRVLEFFGTYTQNELPEKQKQSAINWLMNVQEENGSWYGKWGICYIYGTWAVLTGLRSLGIPSSDPSVKRAALWLEHIQHEDGGWGESCQSSVEKRFVTLPFSTPSQTAWALDALISYYDKETPVIRKGISYLLSNSYINEKYPTGTGLPGGFYIRYHSYAHIYPLLTLAHYAKKYRK

SEQ ID NO: 42 - protein, 620 aa, Bacillus cereus
MSNLLLYEKVHEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSIQSPIIEKAIMGITSYIWKVERGSHLQNSPSTIWDTALLSYALQEAQVPKASKVIQNASAYLLRKQQTKKVDWSVHAPDLFPGGWGFSDVNTTIPDIDDTTAVLRALARSRGNEHVDNAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVLTGLRSLGIPSSDSSLKRAVLWLEHIQHEDGGWGESCQSSVEKRFVTLPFSTPSQTAWALDALISYYDKETPVIRKGISYLLSNPYINEKYPTGTGLPGGFYIRYHSYAHIYPLLTLAHYAKKYRK

SEQ ID NO: 43 - protein, 620 aa, Bacillus cereus
MNALLLYEKVHEEIARRTTALQTMQRQDGTWRFCFEGAPLTDCHMIFLLKLLGRDKEVEPFVKRLASLQTNEGTWKLYDDEMGGNLSATIQSYAALLASKKYTKEDANMKRAEMFITERGGVARAHFMTKFLLAIHGEYEYPSLFHLPTPIMFLQNDSPLSIFELSSSARIHLIPMMLCLNKRFRVGKKLLPNLNHIAGGGGEWFREDQSPMFQTLLGNVKQIISYPLSLHHKGNEEVERFMKERIDENGTLYSYASASFYMIYALLALGHSIQSPMIQKAITGITSYIWKMERGNHLQNSPSTVWDTALLSYALQEARVSKESKMIQNASAYLLKKQHKKKADWSVHAPVLIPGGWGFSDVNTTVPDVDDTTAVLRALAQSRGNGNVDDAWKKGTNWIKGLQNNDGGWGAFEKGVTSKLLANLPIENASDMITDPSTPDITGRVLEFFGTYTQNELPEKQKQSAINWLMNEQEENGSWYGKWGICYIYGTWAVMTGLRALGITSAHPSLKRATLWLEHIQHEDGGWGESCQSSVEKRFATLPFSTPSQTAWALDALISYYDKETPAIRKGISYLLANPYVNEKYPTGTALPGGFYIHYHSYAHIYPLLTLAHYAKKYKK

SEQ ID NO: 44 - protein, 620 aa, Bacillus cereus
MSGVLLYDKVHEEIERRTTALQTMQRQDGTWQFCFEGALLTDCHMIFLLKLLGRNDEIEPFVKRLASLQTNEGTWKLYEDEKGGNLSATIQAYAALLASEKYSKEDMNMRRAEMFIKEHGGVSRAHFMTKFLLAIHGEYEFPALFHFPTPILFLQDDSPLSIFGLSSSARIHLIPMMICMNKRFRVEKKLLPNLNHIAGGGGQWFREERSPLFQSLLGDVKKVISYPLSLHHKGYEEVERFMKERIDENGTLYSYASATFYMIYALLALGHSIQSPIIEKAVTGLKSYIWKMDRGSHLQNSPSTVWDTALLSYSLQEAKVTNENKMIQRATEYLLQKQQTKKVDWSVHASSLVAGGWGFSDVNTTIPDIDDTTAALRALARSRGNDRVDDAWGRGVEWVKGLQNNDGGWGAFERGVTSKLLSNLPIENASDMITDPSTPDITGRVLELFGTYAPNELLEEQKKKAIKWLMDVQEQNGSWYGKWGICYIYGTWATMTGLRALGVPSTHPSLKKAASWLEHLQHEDGGWGESCQSSVEKKFISLPFSTPSQTAWALDALISYYDQETPIIRKGITYLLAQSTMNEKYPTGTGLPGGFYIRYHSYGHIYPLLALAHYVKKYRK

SEQ ID NO: 45 - protein, 620 aa, Bacillus cereus
MSGVLLYDKVREEIERRTTALQTMQRQDGTWSFCFEGALLTDCHMIFLLKLLGRNDEIEPFVKRLASLQTNEGTWKLYEDENGGNLSATIQAYAALLASEKYSKEDINMRRAEMFIKEHGGVSRAHFMTKFLLAIHGEYEFPTLFHFPTPILFLQDDSPLSIFELSSSARIHLIPMMICMNKRFRVEKKLLPNLNHIAGEGGQWFREERSPLFQSFVGDVKKVIAYPLSLHHKGYEEVERFIGERIDENGTLYSYASATFYMIYALLALGHSIQSPIIEKAVIGLKSYIWKMDRGSHLQNSPSTVWDTALLSYSLQEANVMKENKMIQKATEYLLQRQQTKRMDWSVHAPSIMAGGWGFSDVNTTIPDVDDTTAALRALARSRGSSRVDSAWERGVEWLKGLQNNDGGWGAFERGVTSRILANLPIENASDMITDPSTPDITGRVLEFFGTYAPNELPEEQKKKAVKWLMDVQELNGSWYGKWGICYIYGTWAAMTGLRALGVPSSHPSLKKAASWLEHLQYEDGGWGESCQSSVEKKFISLPFSTPSQTAWALDALISYYDQETPIIRKGISYLLAQPTMNEKYPTGTGLPGGFYIRYHSYGHIYPLLALAHYIKKYKK

SEQ ID NO: 46 - protein, 619 aa, Bacillus cereus
MLLYEKVHEEVKEKMAALQAMQQQDGTWRFCFEGSPLTDCYMIFLLTLLGQDQEIEPFVARLAALQTNEGTWKLYEDEPDGNLSATIQAYAALLVSKMYKKEDINMKRAEVFIRKQGGITKAHFMTKFLLALHGGYEYPPLFHFPTPILFLSEDSPLSIFELSSSARIHLIPMMLCMNKRFTVSKKMLPNLDYISGGSKEQWFREERSPLFQTLLRDVTKFLSYPLSLHYKGDKAAERFMIERIDTNGTLYSYASATFYMIYALLALGHSIQSPLISNAVLGLKTYVWNMDRWAHLQNSPSTVWDTALLSYSLQEARVPHDNEMIQKAINYLLQKQHKEKKDWSVHAPTLDAGGWGFSDVNTTIPDVDDTTAVLRALAGSRQGNPKVESAWRKGIEWVKGLQNSDGGWAAFEKGVTSKVLTHLPLDNSGDMITDPSTVDITGRVLEFFGTYAPNELQGDQKDRAIRWLIYTQEKNGSWHGKWGVCYIYGTWAALTGLRAVGVPSNHIALQKAATWLESIQHSDGGWGESCRSSVEKKFISLPFSTPSQTAWALDALIACYDSETPTIRKGISYLLKHSTKHQEYPTGTALANGFYIRYHSYHHIFPLLTFAHYIKKYRK

SEQ ID NO: 47 - protein, 617 aa, Bacillus cereus
MLLYEKVHEEIVRRATALQTMQWQDGTWRFCFEGAPLTDCHMIFLLKLLGREKEIEPFVERIASLQTNEGTWKLYEDEVGGNLSATIQSYAALLASKKYTKEDANMKRAENFIKERGGVARAHFMTKFLLAIHGGYEYPSLFHLPTPIMFLQNDSPLSIFELSSSARIHLIPMMLCLNKRFRVGKKLLPNLNHIAGGGGEWFREDRSPVFQTLISDVKQIISYPLSLHHKGYEEIERFMKERIDENGTLYSYATASFYMIYALLALGHSPQSSMIQKAIAGLTSYIWKMGRGSHLQNSPSTVWDTALLSYALQEARVSKDNKMIQNATAYLLKKQHTKKADWSVHAPALIPGGWGFSDVNTTIPDIDDTTAVLRALARSRGNKNIDNAWQKGVNWIKGLQNNDGGWGAFEKGVTSKLLANLPIENASDMITDPSTPDITGRVLEFFGTYAQNGLPEKQKQSAINWLMNAQEENGSWYGKWGICYIYGTWAVMTGLRSLGIPSSNPSLKRAASWLEYIQHEDGGWGESCHSSVEKRFVTLPFSTPSQTAWALDALISYYDTETPAIRKGVSYLLSNPYVNERYPTGTGLPGAFYIRYHSYAHIYPLLTLAHYLKKYRK

SEQ ID NO: 48 - protein, 617 aa, Bacillus cereus
MLLYEKAHEEIARRATALQTMQRQDGTWRFCFEGAPLTDCHMIFLLKLLGRDKEIEPFVKRLASLQTNEGTWKLYEDEVGGNLSATIQSYAALLASKKYTKEDANMKRAENFIKERGGVARAHFMTKFLLAIHGEYEYPSLFHLPTPIMFLQNDSPLSIFELSSSARIHLIPMMVCLNKRFRVGKKLLPNLNHIAGGGGEWFREDRSPLFQTLLSDVKQIISYPLSLHHKGYEEVERFMKERIDENGTLYSYATASFYMIYALLALGHSLQSSLIQKAIAGITSYIWKMERGSHLQNSPSTVWDTALLSYALQEAHVPKDHKMIQQTITYLLKKQHTKKADWSVHALALTPGGWGFSDVNTTIPDVDDTTAVLRALARSRGNENIDNAWKKGVNWIKGLQNNDGGWGAFEKGVTSKLLANLPIENASDMITDPSTPDITGRVLELFGTYTQNELPKKQKQSAINWLMNVQERNGSWYGKWGICYIYGTWAVMTGLRSLGIPSNNPSLKRAALWLEHIQHEDGGWGESCQSSVEKRFVTLPFSTPSQTAWALDALISYYDKETPTIRKGVSYLLANPYVNEKYPTGTGLPGGFYIRYHSYAQIYPLLTLAHYTKKYQK

SEQ ID NO: 49 - protein, 617 aa, Bacillus cereus
MLLYEKVYEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLLSEVKKIITYPLSLHHKGYEEVERFMKERIDENGTLYSYATASFYMIYALLALGHSIQSPIIQKAITGIASYIWKMERGSHLQNSPSTVWDTALLSYALQEAQVPKASKVIQNASAYLLRKQQTKKVDWSVHAPNLFPGGWGFSDVNTMIPDIDDTTAVLRALARSRGDENVDNAWKRAVNWVKGLQNNDGGWGAFEKGVTSRILANLPIENASDMITDPSTPDITGRVLEFFGTYAQNELPEKQKQSAINWLMNVQEENGSWYGKWGICYIYGTWAVLTGLRSLGIPSSDPSLKRAALWLEHIQHEDGGWGESCQSSVEKRFVTLPFSTPSQTAWALDALISYYEKETPIIRKGISYLLSNPYVNEKYPTGTGLPGGFYIRYHSYAHIYPLLTLAHYTKKYRK

SEQ ID NO: 50 - protein, 486 aa, Bacillus coahuilensis
MAEAISYPRRVHIITTKFPVNFYDFSVFGRSNIAPILLLADSKFQIPKTTETPDISHLYVRELYWWSEDRGWNGFTKAINKGVNNLIGLPNELHTLGRKQAENYMLDRLEDDGTLLSYYSSTFFMIYALLSVGYTKDHKVIKKAARGLLSMNTTVKDTIHIQYTTAHIWNTSLISHALQTAGASPDDTMVMRANHYLLQRQHTKFGDWAIYQPNLGPGGWGFSHSNTFNPDVDDTTASLRSIQNSLHSHPNYQSSWYRGLSFTLGMQNQDGGFPAFEKGVDKTFLHLLPVQGAEFLLTDPSTPDLTGRTLEFLGESAHLYKDSGAIKRGVNWLIENQRRDGSWYGRWGICYIYGTWAALTGLQAVGVSKEHPSVQEGIDWLKSIQQDDGGWGESCESDSQKTYIPLSKSTVTQTAWAVDALIAYEKEETVEIKKGMEYLLENWNHEDWTMDYPMGQGMAKAFYIHYHSYRYVFPLLTMGHYMRKFM

SEQ ID NO: 51 - protein, 619 aa, Bacillus cytotoxicus
MVLYGRVCAEIERTITALHTMQQQDGAWRFCFEGSPLTDCHMIFLLRLLEKEEEIEPFVARLTSIQTNEGTWKLYEDERAGNVSTTIQAYAALLASGMYTKEDVNMKRAEAFIQERGGIARSHFMTKFLLALHGGYEYPRMFYFPTPILFLPEDSPLSIFELSSSARIHLIPMMICMNKRFTVSKTILPNLDHISGSSKSEWFREDRSSLFETILGEVKKFVTYPLSLHHKGDKEAERFMIERIDRNGTLYSYASATFYMIYALLALGHHIQSPLIQQAVAGLRTYKWHMEAGIHLQNSPSTVWDTALLSYALQEANVNESTPMIQTATEYIWQRQHHEKKDWSLHAPTLSPGGWGFSDVNTTIPDVDDTTAALRALARSRKRNRRIEEAWKKGVNWVKGLQNKDGGWAAFEKGVTNRFLTHLPLENSGDMMTDPSTADITGRVLEFFGTYAPNELQDHQKNRAITWLMDVQENNGSWYGKWGVSYIYGTWAALTGLRAVGVANTHPALKKAVMWLERIQHRDGGWGESCRSSIEKRFVPLSFSTPSQTAWAIDALISYYDEETPVIRKGISYLLEHAASHQEYPTGTGLPNGFYIRYHSYSYMYPLLTFAHYINKYRK

SEQ ID NO: 52 - protein, 629 aa, Bacillus licheniformis
MRSILEDVKAFRQKTLAELQNRQRSDGSWRFCFEGPVMTDSFFILMLTSLGDQDSSLIASLAERIRSRQSEDGAFRNHPDERAGNLTATVQGYTGMLASGLYDRKAPHMQKAEAFIKDAGGLKGVHFMTKWMLAANGLYPWPRAYIPLSFLLIPSYFPLHFYHFSTYARIHFVPMAITFNRRFSLKNNQIGSLRHLDEAMSKNPLEWLNIRAFDERTFYSFNLQWKQLFQWPAYVHQLGFEAGKKYMLDRIEEDGTLYSYASATMFMIYSLLAMGISKNAPVVKKAVSGIKSLISSCGKEGAHLENSTSTVWDTALISYAMQESGVPEQHSSTSSAADYLLKRQHVKKADWAVSNPQAVPGGWGFSHINTNNPDLDDTAAALKAIPFQRRPDAWNRGLAWLLSMQNKDGGFAAFEKDVDHPLIRNLPLESAAEAAVDPSTADLTGRVLHLLGLKGRFTDNHPAVRRALRWLDHHQKADGSWYGRWGVCFIYGTWAALTGMKAVGVSANQTSVKKAISWLKSIQREDGSWGESCKSCEAKRFVPLHFGTVVQSSWALEALLQYERPDDPQIIKGIRFLIDEHESSRERLEYPTGIGLPNQFYIRYHSYPFVFSLLASSAFIKKAEMRETY

SEQ ID NO: 53 - protein, 620 aa, Bacillus mycoides
MSGVLLYDKVHEEIERRTTALQTMQRQDGTWQFCFEGALLTDCHMIFLLKLLGRNDEIEPFVKRLVSLQTNEGTWKLYEDEKGGNLSATIQAYAALLASERYSKEAMNMRRAEMFIKEHGGVSRAHFMTKFLLAIHGEYEFPALFHFPTPILFLQDDSPLSIFGLSSSARIHLIPMMICMNKRFRVEKKLLPNLNHIAGGGGQWFREERSPLFQSFLGDVKKVISYPLSLHHKGYEEVERFMKERIDENGTLYSYASATFYMIYALLALGHSIQSPIIEKAVTGLKSYIWKMDRGSHLQNSPSTVWDTALLSYSLQEAKVTNENKMIQRATEYLLQKQQTKKVDWSVHASSLVAGGWGFSDVNTTIPDIDDTTAALRALARSRGNDRVDDAWGRGVEWVKGLQNNDGGWGAFERGVTSKLLSNLPIENASDMITDPSTPDITGRVLELFGTYAPNELLEEQKKKAIKWLMDVQEQNGSWYGKWGICYIYGTWATMTGLRALGVPSTHPALKKAASWLEHLQHEDGGWGESCQSSVEKKFISLPFSTPSQTAWALDALISYYDQETPIIRKGISYLLAQSTMNEKYPTGTGLPGGFYIRYHSYGHIYPLLALAHYVKKYRK

SEQ ID NO: 54 - protein, 619 aa, Bacillus mycoides
MLLYEKVRQEVERKVTALRTTQYQDGAWRFCFEGSPLTDCHMIFLLRLLGQNGEMEPFVTRVASLQTNEGTWKLYEDESVGNLSTTINAYVALLASGRYTKEDINMKRAEAFIRRQGGITKAHFMTKFLLALHGGYEYPSLFHFPTPMLFLPEDSPLSIFELSSSARIHLIPMMICMNKRFTVSKTIFPNLDYISGGSKKQWFREERSPLFQTLLGDVKKFLSYPLSLQHKGYKEAERFMIERIETNGTLYSYASATFYMIYALLALGHSIQSPLISNAVLGLKSYIWNMNKGTHLQNSPSTVWDTALLSYSLQEAGVPNDNQMIQKATDYLLQKQHKEKKDWSVHAPSLDAGGWGFSDVNTTIPDIDDTTAALRAIARSREGNQRIEEDWRKGIEWVKGLQNIDGGWAAFERGVTSHFLTHLPLDNAGDMTTDPSTSDITGRVLEFFGTYAPHQLKDDQKDRAIKWLMQAQEKNGSWYGKWGVCYIYGTWAVLTGLRAVGVPSNHTALQKAATWLERIQHNDGGWGESCRSSIEKHFISLPFSTPSQTAWALDALITFYDTETPVIRKGISYLLAHLNQNQDYPTGIGLPDGFYIRYHSYHHIFPILTFAHYIKKYMK

SEQ ID NO: 55 - protein, 619 aa, Bacillus pseudomycoides
MLLYEKVRQEVERKVTALRTMQYQDGAWRFCFEGSPLTDCHMIFLLRLLGQNGEMEPFVTRVASLQTNEGTWKLYEDESVGNLSTTINAYVALLASGRYTKEDINMKRAEAFIRRQGGITKAHFMTKFLLALHGGYEYPSLFHFPTPMLFLPEDSPLSIFELSSSARIHLIPMMICMNKRFTVSKTILPNLDYISGGSKKQWFREERSSLFQRLLGDVKKFLSYPLSLQHKGYKEAERFMIERIETNGTLYSYASATFYMIYALLALGHSIQSPLISNAVLGLKSYIWNMNKGTHLQNSPSTVWDTALLSYSLQEAGVPNDNQMIQKATDYLLQKQHKEKKDWSVHAPSLDAGGWGFSDVNTTIPDIDDTTAALRAIARSREGNQRIEEAWRKGIEWVKGLQNIDGGWAAFERGVTSHFLTHLPLDNAGDMTTDPSTSDITGRVLEFFGTYAPHQLKDDQKDRAIKWLMQAQEKNGSWYGKWGVCYIYGTWAALTGLRAVGVPSNHTALQKAATWLERIQHNDGGWGESCRSSIEKHFISLPFSTPSQTAWALDALITFYDTETPVIRKGISYLLAHLNQNQDYPTGIGLPDGFYIRYHSYHHIFPILTFAHYIKKYMK

SEQ ID NO: 56 - protein, 624 aa, Bacillus pumilus
MQDFKTKVNVYMDELHMQMQHRQREDGAFVFCFEGSMMTNAFLIMLLKAVGDTDQALVHQLAEAIREKQNEDGSFSLYHDQAGHVTATVQGYCGMLVSGRYQQDEPHMEKAARYIRSKGGLKDVHFMTKWMLAVNGMHPWPYFYAPLSFLLIPTYFPLHFYHLSAYARIHFVPMMIALNKRYTSHEQFPSLSHLDANMSKNPFDWFMAREERSTHHFLAYMRSYTALDSRFDFFGYEAAKRYMFDRLEKDGTLYSYLSASIFMVYALMSLGYSPGHHLILKAVKGMKQLVTDCGGKKYAENSTSTVWDTALVSYASQRAGRTQDDPVIKKSFTYLLNRQQMKKADWAIHNRHAAPGGFGFSDLNTNNPDCDDTQIVLKAIPQTYAPVQWKRGFDWLLSMQNRDGGFSAFEKNQDHFLLRHLPLESAEDAAIDPSTPDITGRVLHLIASEENDKSPLMQRQKDHCVKWLLDHQEKDGSWYGRWGVCYIYGTWAALTGLKASGIPSSHPAVQKACRFLKTIQLEDGSFGESCKSSEVKRYVPLPFGTVVQTAWAAEALLQYVQPDDKSILKAISFLIQHQHSSKALHYPVGIGLPKQFYITYHSYPFVFPMMACSTFLEEMRRKNE

SEQ ID NO: 57 - protein, 624 aa, Bacillus pumilus
MQDFKTKVNEYIDELHMQLQRRQREDGAFVFCFEGPMMTNAFLIMLLKAVGDSDQALVHQLAEAIREKQNEDGSFSLYHDQAGHVTATVQGYCGMLVSGRYQQDEPHMEKAAHFIRSNGGLKDVHFMTKWMLAVNGMHPWPYFYAPLSFLLIPTYFPLHFYHLSAYARIHFVPMMIALNKRYTSHEQFPSLAHLDANMSKNPFDWFMAREERSTHHFLAYMRSYTALDSRLDFFGYEAAKRYMFDRLEKDGTLYSYLSASIFMVYALMSLGYSPGHHLILKAVKGMKQLVTDCGGRKYAENSTSNVWDTALVSYASQQAGRTQDDPVIKKSFTYLLNRQQMKKADWAIHNRHAAPGGFGFSDLNTNNPDCDDTQIVLKAVPQTYAPVQWKRGFDWLLSMQNQDGGFSAFEKNQNHFLLRHLPLESAEDAAIDPSTPDIAGRVLHLIALEENSMSPLMQRQKDHCVKWLLDHQEKNGSWFGRWGVCYIYGTWAALTGLKTAGISSSHSAVQKACRFLKTIQLEDGSFGESCKSAEVKRYVPLPFGTVVQTAWAAEALLQYVQPDDKVILKAISFLIQHQHSSEALHYPVGIGLPKQFYITYHSYPFVFPMMACSTFLEEMRRKNE

SEQ ID NO: 58 - protein, 638 aa, Bacillus sp.
MKNRNKGAGCMQLVKSEIERLKQQLLSEQTPDGSWNHPFDTGCMTDIYMIVLLRTLEEEDEEELIKELAKGILSRQGKDGAWRLFHDHHEGSLSLTIEAYYALLYSGYYEKNHPALVKARRVITKGGGLKKAGMYTKIMLALTGQYPWPLLFPVPMEVILLPRSFPLNMYDISVFGRSNLIPVILLGNKKFSRKTALSPDLGDLSVRDDDDPWPELRSAEWRSLTSFLAAGVKALVGIPRQIRAWSIEKAREYMQSHTEPDGTLYNYFSSTFYMIFALLALGGGPEEPAIRNAVAGLKRMTVKADGRTHIQYTTAAVWNTALISHALQEAGVPPKENAIQKANQYLAGQQHRRFGDWIVHNTKAEPGGWGFSRFNTINPDVDDTTAALRSLYQPAREKPHYDDIWKKGLLWTLSMQNRDGGWPAFERNVDKKLLHLLPIQGAEFILTDPSTADLTGRTLEFLGKAGYADASLPPIKKAVKWLKKHQEPNGSWYGRWGICYIYGTWAAVTGMAAVGVTLEDKSMKKGIDWLLSIQNEDGGWGESCRSDMEKKYIPLKESTLTQTAWAVDALAAAGMADSTPSRKGAAFLVREGKRKDWTADYPMGQGMANFFYIHYHSYRCIWPLLALSHYIEKSEAPD

SEQ ID NO: 59 - protein, 625 aa, Bacillus sp.
METLIDPEISRLTQRLLEDQEEDGAWRYCFENSLMTDAYMIVLIRSLGIKKERLVQELADRLLSQQEEKGFWKIYRDEVEGNLSATVEAYFALLWSGAVKEKDENMVKARDCILSGGGLDKVHSMTKFMLAAHGQYPWDRFFPVPVEVILLPTYFPVSFTDFSAYARVHLAPLLLLKSERYIRKTSTTPDLSYLLKDQEDFSFFREEERSFIEYVTSGVEAIAAFPANLNDLAKKTALNYMLARLEPDGSLYSYFSSSFYMIIALLSQGYSRKDPLVVNAIKALISYQCKGDGYPHIQNSPSTIWDTALISHALQSSGVDSRNAQILKASHYLYRHQHTQKGDWASEAPQTAPGGWGFSESNTINPDVDDTTAALRALKLDAYTDPVKRMAWNRGVKWALSMQNKDGGWPAFEKNKNKDILSWVPMDGAEDAALDRSCADLTGRTLEFLGNDAGMGRENSQVLKGIEWLMNNQENDGSWYGKWGICYIYGTWAALTGMMAAGMSADHQSIIKAIKWLYQIQNSDGGWGESCRSDKERKYISLGASTPSQTAWALDALISINDHPTKEIDRGIESLVRLLNTDDWRKEYPTGAGLPGRFYIHYHSYPYIWPLLALSNYKTKFLEVR

SEQ ID NO: 60 - protein, 632 aa, Bacillus subtilis
MGTLQEKVRRFQKKTITELRDRQNADGSWTFCFEGPIMTNSFFILLLTSLDEGENEKELISSLAAGIHAKQQPDGTFINYPDETRGNLTATVQGYVGMLASGCFHRTEPHMKKAEQFIISHGGLRHVHFMTKWMLAANGLYPWPALYLPLSLMALPPTLPIHFYQFSSYARIHFAPMAVTLNQRFVLINRNISSLHHLDPHMTKNPFTWLRSDAFEERDLTSILLHWKRVFHAPFAFQQLGLQTAKTYMLDRIEKDGTLYSYASATIYMVYSLLSLGVSRYSPIIRRAITGIKSLVTKCNGIPYLENSTSTVWDTALISYALQKNGVTETDGSVTKAADFLLERQHTKIADWSVKNPNSVPGGWGFSNINTNNPDCDDTTAVLKAIPRNHSPAAWERGVSWLLSMQNNDGGFSAFEKNVNHPLIRLLPLESAEDAAVDPSTADLTGRVLHFLGEKVGFTEKHQHIQRAVKWLFEHQEQNGSWYGRWGVCYIYGTWAALTGMHACGVDRKHPGIQKALRWLKSIQNDDGSWGESCKSAEIKTYVPLHRGTIVQTAWALDALLTYENSEHPSVVKGMQYLTDSSSHSADSLAYPAGIGLPKQFYIRYHSYPYVFSLLAVGKYLDSIEKETANET

SEQ ID NO: 61 - protein, 556 aa, Bacillus subtilis
MGTLQEKVRRFQKKTITELRDRQNADGSWTFCFEGPIMTNSFFILLLTSLDEGENEKELISSLAAGIHAKQQPDGTFINYPDETRGNLTATVQGYVGMLASGCFHRTEPHMKKAEQFIISHGGLRHVHFMTKWMLAANGLYPWPALYLPLSLMALPPTLPIHFYQFSSYARIHFAPMAVTLNQRFVLINRNISSLHHLDPHMTKNPFTWLRSDAFEERDLTSILLHWKRVFHAPFAFQQLGLQTAKTYMLDRIEKDGTLYSYASATIYMVYSLLSLGVSRYSPIIRRAITGIKSLVTKCNGIPYLENSTSTVWDTALISYALQKNGVTETDGSVTKAADFLLERQHTKIADWSVKNPNSVPGGWGFSNINTNNPDCDDTTAVLKAIPRNHSPAAWERGVSWLLSMQNNDGGFSAFEKNVNHPLIRLLPLESAEDAAVDPSTADLTGRVLHFLGEKVGFTEKHQHIQRAVKWLFEHQEQNGSWYGRWGVCYIYGTWAALTGMHACGLTESIPVYKRLCVGSNPYKMMTEAGENPAKAPKSKHMYRFIEEPLYKRPGL

SEQ ID NO: 62 - protein, 631 aa, Bacillus thuringiensis
MNIVIRISKGWVSNLLLDEKAHEEIVRRATALQTMQWQDGTWRFCFEGAPLTDCHTIFLLKLLGRDKEIEPFVERVASLQTNEGTWKLYEDEVGGNLSATIQSYAALLASKKYTKEDANMKRAENFIQERGGVARAHFMTKFLLAIHGEYEYPSLFHVPTPIMFLQNDSPFSIFELSSSARIHLIPMMLCLNKRFRVGKKLLPNLNHIAGGGGEWFREDRSPVFQTLLSDVKQIISYPLSLHHKGYKEIERFMKERIDENGTLYSYATASFYMIYALLALGHSLQSSMIQKAIAGITSYIWKMERGNHLQNSPSTVWDTALLSYALQEAQVSKDNKMIQNATAYLLKKQHTKKADWSVHAQALTPGGWGFSDVNTTIPDIDDTTAVLRALARSRGNKNIDNAWKKGVNWIKGLQNNDGGWGAFEKGVTSKLLAKLPIENASDMITDPSTPDITGRVLEFFGTYAQNELPEKQIQRAINWLMNVQEENGSWYGKWGICYIYGTWAVMTGLRSLGIPSSNPSLTRAASWLEHIQHEDGGWGESCHSSVEKRFVTLPFSTPSQTAWALDALISYYDTETPAIRKGVSYLLSNPYVNERYPTGTGLPGAFYIRYHSYAHIYPLLTLAHYIKKYRK

SEQ ID NO: 63 - protein, 653 aa, Bacillus thuringiensis
MSNLLLYEKAHEEIARRATALQTMQREDGTWRFCFEGAPLTDCHMIFLLKLLGRDKEIEPFVKRLATLQTNEGTWKLYEDEVGGNLSATIQSYAALLASGKYTKEDANMKRAENFIKERGGVARAHFMTKFLLAIHGEYEYPSLFHVPTPIMFLQNDSPLSIFELSSSARIHLIPMMLCLNKRFRVGKKLLPNLNHIAGGGGEWFREERSPLFQTLLSDVKQIISYPLSLHHKGYEEVERFMKERIDENGTLYSYATASFYMIYALLALGHSLQSSMIQKAIAGITSYIWKMESGNHVQNSPSTVWDTALLSYALQEAHVPKDNKMLQNATAYLLKKQHTKKADWSVHAPALTPGGWGFSDVNTTVPDVDDTTAVLRVLARSKGNEKLDHAWQKGINWVKGLQNNDGGWGAFEKGVTSRILANLPIENASDMITDPSTPDITGRVLEFFGTYAQNELPEKQKQSAINWLMNAQEENGSWYGKWGICYIYGTWAVMTGLRSFGIPSSNPSLKRAALWLEHIQHKDGGWGESCHSSVEKRFVTLPFSTPSQTAWALDALISYYDTETPVIRKGISYLLANPYVNEKYPTGTGLPGGFYIRYHSYAHIYPLLTLTHYIKNIENKPRDISRFIFLGSRSLLKRIRLCFPYFSVDWRF

SEQ ID NO: 64 - protein, 620 aa, Bacillus thuringiensis
MSNLLLYEKVHEEIARRTTALQTMQRQDGTWRFCFEGAPLTDCHMIFLLKLLGRDKEIEPFVKRLASLQTNEGTWKLYEDEAGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLLSDVKKIITYPLSLHHKGYEEVERFMKERIDENGTLYSYATASFYMIYALLALGHSIQSPIIEKAITGITSYIWKMERGSHLQNSPSTIWDTALLSYALQEAQVPKASKVIHNASAYLLRKQQTKKVDWSVHAPDLFPGGWGFSDVNTTIPDIDDTTAALRALARSRGNENVDNAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVMTGLRSFGIPSSNPSLKRAALWLEHIQHEDGGWGESCQSSVEKRFVTLPFSTPSQTAWALDALISYYDKETPVIRKGISYLLSNSYINEKYPTGTGLPGGFYIRYHSYAHIYPLLTLAHYAKKYKK

SEQ ID NO: 65 - protein, 620 aa, Bacillus thuringiensis
MSNLLLYEKVYEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKGRIDENGTLYSYATASFYMIYALLALGHSIQSPIIEKAIMGITSYIWKMERGSHLQNSPSTIWDTALLSYALQEAQVPKVSKVIQNASAYLLRKQQTKKVDWSVHAPDLFPGGWGFSDVNTTIPDIDDTTAVLRALARSRGNENVDNAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVLTGLRSLGIPSSDSSLKRAVLWLEHIQHEDGGWGESCQSSVEKRFVTLPFSTPSQTAWALDALISYYDKETPVIRKGISYLLSNPYINEKYPTGTGLPGGFYIRYHSYAHIYPLLTLAHYAKKYRK

SEQ ID NO: 66 - protein, 620 aa, Bacillus thuringiensis
MSNLLLYEKVHEEIARRTTALQTMQRQDGTWQFCFEGAPLTDCHMIFLLKLLGRDKEIEPFVKRLASLQTNEGTWKLYEDEMGGNLSATIQSYAALLASEKYTKEDANMKRAENFIKERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLASDVKKIITYPLSLHHKGYEEVERFMKERIDENGTLYSYATASFYMIYALLALGHSIQSPIIEKAIMGITSYIWKMERGSHLQNSPSTIWDTALLSYALQEAQVPKASKVIQNASAYLLRKQQTKKVDWSVHAPDLFPGGWGFSDVNTTIPDIDDTTAVLRALARSRGNENVDNAWKRAVNWVKGLQNNDGGWGAFEKGVTSRILANLPIENASDMITDPSTPDITGRVLEFFGTYGQNELPEKQKQSAINWLTNAQEENGSWYGKWGICYIYGTWAVLTGLRSLGIPSSDPSLKRAALWLEHIQHEDGGWGESCHSSVEKRFVTLPFSTPSQTAWALDALISYYDKETPVIRKGISYLLSNPYINEKYPTGTGLPGGFYICYHSYAHIYPLLTLAHYAKKYRK

SEQ ID NO: 67 - protein, 620 aa, Bacillus thuringiensis
MSNLLLYEKVHEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLLSEVKKIITYPLSLHHKGYEEVERFMKERIDENGTLYSYATASFYMIYALLALGHSIQSPIIQKAITGIASYIWKMERGSHLQNSPSTVWDTALLSYALQEAQVPKASKVIQNASAYLLRKQQTKKVDWSVHAPNLFPGGWGFSDVNTMIPDIDDTTAVLRALARSRGDENVDNAWKRAVNWVKGLQNNDGGWGAFEKGVTSRILANLPIENASDMITDPSTPDITGRVLEFFGTYAQNELPEKQKQSAINWLMNVQEENGSWYGKWGICYIYGTWAVLTGLRSLGIPSSDPSLKRAALWLEHIQHEDGGWGESCQSSVEKRFVTLPFSTPSQTAWALDALISYYEKETPIIRKGISYLLSNPYVNEKYPTGTGLPGGFYIRYHSYAHIYPLLTLAHYTKKYRK

SEQ ID NO: 68 - protein, 617 aa, Bacillus thuringiensis
MLLYEKVHEEIARRTTALQTMQRQDGTWRFCFEGAPLTDCHMIFLLKLLGKDKEIEPFVKRLASLQTNEGTWKLYEDEVGGNLSATIQSYAALLASEKYTKEDVNMKRAEMFINEHGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSIQSPIIQKAITGITSYIWKMERGSHLQNSPSTVWDTALLSYALQEAQVPKASKVIHNASAYLLRKQQTKKVDWSVHAPDLFPGGWGFSDVNTTIPDIDDTTAALRALARSRGNENVDTAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVLTGLRSLGIPSSDPSVKRAALWLEHIQHEDGGWGESCQSSVEKRFVTLPFSTPSQTAWALDALISYYDKETPVIRKGISYLLSNSYINEKYPTGTGLPGGFYIRYHSYAHIYPLLTLAHYAKKYRK

SEQ ID NO: 69 - protein, 617 aa, Bacillus thuringiensis
MLLYEKVHEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAVHGEYEYPSLFHLPTPIMFLQNDSPLSIFELSSSARIHLIPMMLCLNKRFRVGKKLLPNLNHIAGGGGEWFREDRSPVFQTLLSEVKKIITYPLSLHHKGYEAVERFMKERIDENGTLYSYATASFYMIYALLALGHSIQSPIIQKAITGITSYIWKMERGSHLQNSPSTVWDTALLSYALQEAQVPKASKGIQNASAYLLRKQQTKKVDWSVHAPDLFPGGWGFSDVNTTIPDIDDTTAVLRALARSRGNENVDNSWKRAVNWVKGLQNNDGGWGAFEKGVTSRILANLPIENASDMIPDPSTPDITGRVLEFFGTYAQNELPEKQKQSAINWLMNIQEENGSWYGKWGICYIYGTWAVLTGLRSLGIPSSDPSLKRAALWLEHIQHEDGGWGESCQSSVEKRFVTLPFSTPSQTAWALDALISYYEKETPVIRKGISYLLSNPYVNEKYPTGTGLPGGFYIRYHSYTHIYPLLTLAHYAKKYRK

SEQ ID NO: 70 - protein, 617 aa, Bacillus weihenstephanensis
MLLYDKVHEEIERRTTALQTMQRQDGTWQFCFEGALLTDCHMIFLLKLLGRNDEIEPFVKRLVSLQTNEGTWKLYEDEKGGNLSATIQAYAALLASEKYSKEDMNMRRAEMFIKEHGGVSRAHFMTKFLLAIHGEYEFPALFHFPTPILFLQDDSPLSIFGLSSSARIHLIPMMICMNKRFRVEKKLLPNLNHIAGGGGQWFREERSPLIQSFLGDVKKVISYPLSLHHKGYEEVERFMKERIDENGTLYSYASATFYMIYALLALGHSIQSPIIEKAVTGLKSYIWKMDRGSHLQNSPSTVWDTALLSYSLQEAKVTNENKMIQRATEYLLQKQQTKKVDWSVHASSLVAGGWGFSDVNTTIPDIDDTTAALRALARSRGNDRVDDAWGRGVEWVKGLQNNDGGWGAFERGVTSKLLSNLPIENASDMITDPSTPDITGRVLELFGTYAPNELLEEQKKKAIKWLMDVQEQNGSWYGKWGICYIYGTWATMTGLRALGVPSTHPALKKAASWLEHLQHEDGGWGESCQSSVEKKFISLPFSTPSQTAWALDALISYYDQETPIIRKGISYLLAQSTMNEKYPTGTGLPGGFYIRYHSYGHIYPLLALAHYVKKYRK

SEQ ID NO: 71 - protein, 698 aa, Bacterium Ellin514
MIKNFTALWPIRRVKGVSVTSQDGHSANGASKPDFEVRPHVDLETAIHRSQSFLLKEQKPEGYWVGELIVDSTLVSDTIAYHHWNGKVDMEWQRKAVNHIFSMQLPDGGWNIYYGGPAEINATVKAYLALKLAGVPVMDPRMLRARSVALSMGGVPRMNTFSKLYLALLGLFPWNYVPTIPCEVILIGKWFHVNFYEMSSWSRSMLVPLAIINHFKPTRKLQNQVKLDELYPEGYHERDLALPPDPEFLTFRNFFLWLDKLHKFAELWVQAGIHPFRRRALKKCEHWMLERFEGSNGLAAIFPAMLNSLIALKALGYPGDHPEVKRAEKELKNLEHETADTVRIEPCFSPVWDTAIVAICLHESGIPSDHPALKKSAEWLIDKEIRFRGDWYFKNPVDVEPSGWVFEFENKWNPDVDDTAMVLLALRKIPTSDVKRRDECFQRGLKWMMAFQCKDGGWAAFDKDCTKGILEKVPFADHNAMLDPECADITARILELLGYEGVGVDHPQIKKALQFIQEEQEDDGSWYGRWGVNYIYGTWQVLRGLRALNINMNQPWLLKARDWLESVQHEDGGWGERCNTYDDPVFKGQGPSTASQTAWAVMGLCTFDDPQRPSLMRGIDYLIKTQNSDGSWTEHEITGTGFPRVFYLKYDMYRNSWPLLALATYRNLYASSEKTANGHTNGHSVQLPEALKTPPAFK

SEQ ID NO: 72 - protein, 651 aa, Bacterium Ellin514
MKSEEVTIKPAVGLEKDELNAAITRSQSFLLCEQKPEGYWVGELMVDSTIVSDTIAYHHWNGKVDPEWQRKAVNHILSMQLPEGGWNIYQNGPPEVNATIKAYLALKLAGIPITDPRMLKARQVALTLGGVPRMNTFSKLYLALLGLWPWKYVPTIPCEVLLLGKWFHVNIWDMSNWSRAMIVPLAIINHYKPTRPVKVDLSELFLEGFHERDLALPKDPQSFTWRNFFLGLDQLHKFAELWVNAGIHPFRRLALKKCEQWMLERFEGSDGLAAIFPAMLNSLIALKSLGYPDDHPEVLRAERELKKLEHETKDTVRIEPCLSPGWDTAIAAMCLRESGVPAEHPRLKKAGDWLVNREVRFKADWHHKNPVDVEPSGWVFQFNNKWNPDLDDTAMVLLALRLIPTDHPRRRDEAFQRGLKWLLAFQCRDGGWAAYDKDCTKNILEKVPFADHNAMLDPECADITARVLELLGFEGYALDHPQVQEAVEYLREHQETDGSWYGRWGVNYIYGTWQTLRGLWALKMDMNQPWLLKARDWLESVQLPDGGWGERCNTYDDPVFKGQGPSTASQTAWAVMALCTFGDPKRPSLVRGIQYLIENQNEDGSWTELETTGTGFPRVYYLKYDIYRNTWPLLAMATYRKMLDPKEVRVK

SEQ ID NO: 73 - protein, 662 aa, Beijerinckia indica
MPEEAILTETHPLDATTIETAITRARKALLGEQRADGHFVFELEADVSIPCEYILFYHFIGRPAPAELEAKIGHYLRARQSAEHDGWPLFQDGAFNISSSVKAYFALKAIGDTPDMPHMQRARTAILAHGGAAAANVFTRSLLALFGLIPWHGIPVMPIEIMHLPEWFPFHIAKISYWGRTVLVPMMVVHALKPKPANTCTIRIDELFVIPPDQVRHWPGSPGKRFPWTAIFAGIDKVLQIAEPYFPRRSRQSAIDKAVAFVTKRLNGEDGLGAIYPAMAYSALMYLSIGRSLSDPHIQLVLKAIDKLVVVKDHEAYVQPCVSPVWDTALASHALMEAGDGDKPILDSLKKGLAWLKPLQVTDIAGDWAWKKPDVKPGGWAFQYGNAYYPDLDDTAVVVMAMDRARDRWPEIDEDNFRPSIARAREWIVGLQSENGGFGAFDADNDRDYLNAIPFADHGALLDPPTADVTARCISMLTQLGEKPENSETLRRAIAYLFAEQEKDGSWFGRWGLNYIYGTWSVLCSLNAAGIAHDAPEVRRAVAWLRTIQNEDGGWGEDAESYALDYAGYQQAPSTSSQTAWAVLGLMAAGEKDDPAVARGIAYLTRTQGEDGFWTEKRFTATGFPRVFYLRYHGYSKFFPLWAMARYRNLHNGNHASVLTGM

SEQ ID NO: 74 - protein, 691 aa, Blastopirellula marina
MEGASPTASNRISQYAVDLRAKARAAVASTCDWLLSHQHADGHWCAELEGDSILQSEYILLLAWLGKERTEIARRCAAHLLKQQEPNGAWTQFPGAPIDVGSSVKAYFALKLTGHDAAADYMVRARNAILEAGGADKVNSFTRFYLALLGQIPFELCPAVPPEMVLLPNWSPINIYRISSWSRTIFVPLSIVWAHRAARDIVEDVSIHELFIRKPEDWPELRCPGLEKPAGLFSWDRFFRTADSGLKLLEKYGLRPLRKRALRQAQQWMLDRFQQSDGPGAIFPPIVWSAIALRTLGYAEDSPEIQYCLDHLERLVLEDGETTKLQPCKSPVWDTSITLRALAAAGLGLAQEPTCRGVEWLLSKEVRVPGDWTNNVDCEPGGWFFEYENAFYPDNDDTSMGIMALADQLAAANITLEVHPGETLANTSVVVGGRGIAEQLAGSSAAMMEQAAAATRRAVAWMVAMQNKDGGWGAFDKNNDAEFLCHVPFADHNAMIDPSTPDLSARVIESFGRLGVTIESPGKLGDTVRRAVAYIRANQLSDGSWFGRWGVNYIYGTWQCLVGLRAVGVPANDPAIEQGKLWLLAHQQACGGWGESCETYEDPSLRGQGSPTASQTAWALLGIIAAGGANLAEVVHGVQYLMDTQREDGAWDEIEFTGTGFPRVFYLKYHYYPIYFPLLALAEWNRATARS

SEQ ID NO: 75 - protein, 610 aa, Blastopirellula marina
MDQDRLQRCYAIARDDLLAQRNGQGHWTGELSTSALSTATAVSALQLVVRHDPAQSERLMPLIEGGVRYLTEHQNPDGGWGDTDRSYSNIATTMLAVAALTIAERREALFEQLAFAENYIEAQGGIPGLRRRYGKDKTFAVPILTNYALAGLVDWREVSPLPFELACLPQKFYKLVKLPVVSYAIPALVAIGQARYFHRPPFNPLMRGLRGAAVKKSLAVLERMQPASGGYLEAAPLTSFVVMSLASIGNASHPVAQNGVQFLVDSVREDGSWPIDSNLANWVTTLSISALATGGDDIAELDCLPWVLANQYQETHPFTGADPGGWGWTDLSGSVPDADDTPGAMLAIAHFFHSPRADNETRRQIASAAISGARWLLDLQNSDGGWPTFCAGWGTQPFDRSGSDLTAHAIRALHAWRSELGDLPVERAIERGLRYLQKQQRDDGSWLPLWFGNQDIHDDENPIYGTVKVLLAYRDLGKMSSETAQRGAAWLAARQNEDGGFGGGPSISTLCGGPGESSVEETALAIEALFAAENSNISAEIVPPAVGWLCQRVEEGSYVNCTPIGFYFSKLWYYEKLYPRVMTVTSLGAALQANASVPPAPETVTTSSDH

SEQ ID NO: 76 - protein, 660 aa, Bradyrhizobium japonicum
MDSVNATAREAKESKISESEILESSIASATQGVLGFQQSDGHWVFELEADCTIPAEYVLLRHYLAEPVDTVLEAKIGNYLRRVQGAHGGWPLVHDGEFDMSASVKAYFALKMIGDSIDAPHMVRAREAIHARGGAIHSNVFTRFMLAMFGIVTWRAVPVLPIEIMLLPFWSPFHINKISYWARTTMVPLMVIAALKPRAKNPKGVGIDELFLQDPRSIGMTAKAPHQSMAWFLLFRSLDAILRVIEPLFPKSLRKRAIDTALAFSEERLNGEDGMGAIYPPMANLVMMYDALGKDENYPPRAVTRRGIDKLLVIGDDEAYCQPCVSPVWDTTLTAHALLEAGGDKAGPAAKHGLDWLIPKQELEVKGDWAVKRPDVRPGGWAFQYNNAYYPDLDDTAVVVMSMDRMRREHGVTGYDSAIDRGREWIEGMQSDDGGWAAFDVNNLEYYLNNIPFSDHGALLDPPTEDVTARCVSMLAQLGETAKTSKHVADGVAYLRKTQHPEGSWYGRWGMNFIYGTWSVLCALNMAGVRHDDPMIRKAADWLASIQNKDGGWGEDTVSYRLDYKGWEAAPSTASQTAWALLALMAAGEVDHPAVARGVEYLIATQNEKGLWDEQRYTATGFPRVFYLRYHGYSKFFPLWGLARYRNLRNTNSRVVGVGM

SEQ ID NO: 77 - protein, 656 aa, Acetobacter pasteurianus
MAADGSALSESRLSSEALDRAVLSAHTALSQAQQDDGHWVYELEADATIPAEYILLEHFMDRIDDALEQKIAIYLRRIQSEEHGGWPLYHNGKFDLSATVKAYFALKAVGDDINAPHMQRAREAILDHGGAERSNVFTRSQLALFGEVPWRATPVMPVELMLLPAKAFFSVWNMSYWSRTVIAPLLVLAALRPVAANPRQVHVRELFVTPPEKVQDWIRGPYRSAWGYVFKGLDSVLRPVVPFIPEKTHKKAIQAALDFIEPRLNGKDGLGAIYPAMANVVMMYRAMGVPDEDPRAKTAWEAVQALIVEKDDEAYCQPCVSPIWDTGLSGHAMIEAASGPNGIAPEKTVAELKKASAWLRSKQILNVKGDWAVRNPNLAPGGWAFQYGNDYYPDVDDTAVVGMLLHREGDPTNAEAIERARTWIVGMQSTDGGWGAFDIDNNKDVLNHIPFADHGALLDPPTADVTARCISFLAQLRNPEDEPVIQRGLEYLRKEQEKDGSWFGRWGTNYIYGTWSALCALNAAGVSHDDPAVVKAVEWLRSVQRADGGWGEGCESYEGGPHGTYGESLPSQTAWAVLGLMAAGRRDDPAVTRGIAWLADQQDANGEWHEDPYNAVGFPKVFYLRYHGYKQFFPLMALARYRNLESSNTRRVSFGF

SEQ ID NO: 78 - protein, 684 aa, Bradyrhizobium sp.
MTLTSSASARAPRDPGNYQTALQSTVRAAADWLIANQKPDGHWVGRAESNACMEAQWCLALWFMGLEDHPLRKRLGQSLLDTQRPDGAWQVYFNAPNGDINATVEAYAALRSLGYPDSEPAVRRAREWIEAKGGLRNIRVFTRYWLALIGEWPWEKTPNIPPEVIWFPLWFPFSIYNFAQWARATLMPIALLSARRPSRPLPPENRLDTLFPRGRDAFDYELPVKANAGGWDKFFRGADKVLHALQNFGNRLNLGLFRPAATSRVLEWMIRHQDFDGAWGGIQPPWIYGLMALYAEGYPLNHPVLAKGLDALNDPGWRVDVGEATYIQATNSPVWDTILTLLAFDDAGVLGDYPDAVDKAVNWVLARQVRVPGDWSMKLPHVKPGGWAFEYANNHYPDTDDTAVALIALAPLRHDPKWKAKGIDEAIQLGVDWLIGMQSQGGGWGAFDKDNNQQILTKIPFCDYGEALDPPSVDVTAHIVEAFGKLGISRNHPSMVQALDYIRKEQEPSGPWFGRWGVNYVYGTGAVLPALAAIGEDMTQPYIGRACDWLVAHQQPDGGWGESCASYMDISAVGRGTTTASQTAWALMALLAANRPQDKDAIERGCMWLVERQSAGTWDEPEFTGTGFPGYGVGQTIKLTDPSLQERLMQGPELSRAFMLRYGMYRHYFPLMALGRALRPQGHG

SEQ ID NO: 79 - protein, 660 aa, Brevibacillus brevis
MRIGTTTNPSMPFPLSSSGAVFYREVNELREVQQEINRIQAFLLQRQQEDGTWRFCLESSPMTDSHMIILLRTLGIHDERLMEKLTAHITALQHDNGAWKLYPDEQEGHLSTTIDSYYALLLSGKYTKNEPRMALARSFILEKGGLTQANMLTKFATALTGQYQWPSHFLVPVEIALLPPSFPVSFYDFVGYARVHLAPMMIVADRNYVKKPDNAPDLSDLYADTPISRGLYPHRFLENFLKEGQSFLATIHDSLQQLPFLPGQLHKLALRRLEQYILARIEPDGTLYNYSTSTFFMIFALLARGFSPKDPLIQKAMQGLTGSVYDYENGAHLQLATSAVWDTALLTFSLQKSGLSPTHPAIQKANRYLLRKQQHTYGDWKIRNPNGKPGGWGFSDYNTMNPDIDDTTAALRSLRLLARTDVTAATAWKRGLEWLLSMQNDDGGWPAFERNTDADFIRHLPIEGADTVSTDPSSADLTGRTLEFLGNYAGRTLTDLHVEKGVRWLLKHQESDGSWYGRWGIAYLYGTWAAITGLMAVGFSPTEPAIQKAVAWLVANQNPDGGWGESCQSDLKKTYVPLGASTPSQTAWAIDALIAVSSKPTAELQRGIRYLLTHNQANDWTTRYPTGGGRPGGTYFAYHSYRWIWPLLALSHYQVKYANT

SEQ ID NO: 80 - protein, 682 aa, Burkholderia ambifaria
MIRRMNKPAPSPWSALDTAIARGRDALMRLQQPDGSWCFELESDATITAEYILMMHFMDKIDDARQEKMARYLRAIQRLDTHGGWDLYLDGDPDLSCSVKAYFALKAAGDSEHAPHMVRARDAILKLGGAARSNVFTRILLATFGQVPWRATPFMPIEFVLFPKWVPISMYKVAYWARTTMVPLLVLCSLKARARNPRNIAIPELFVTPPDQERQYFPPARGMRRAFLALDRVVRHVEPLLPKRLRQRAIRHAQAWCAERMNGEDGLGGIFPPIVYSYQMMDVLGYPDDHPLRRDCENALEKLLVTRPDGSMYCQPCLSPVWDTAWSTMALEQARGVAVPEAGAPAGALDELDARIARAYDWLAERQVNDLRGDWIENAPADTQPGGWAFQYANPYYPDIDDSAVITAMLDRRGRTHRNADGSHPYAARVARALDWMRGLQSRNGGFAAFDADCDRMYLNAIPFADHGALLDPPTEDVSGRVLLCFGVTKRADDRASLARAIDYVKRTQQPDGSWWGRWGTNYLYGTWSVLAGLALAGEDPSQPYIARALAWLRARQHADGGWGETNDSYIDPALAGTNAGESTSNCTAWALLAQMAFGDGESESVKRGIAYLQSVQQDDGFWWHRSHNAPGFPRIFYLKYHGYTAYFPLWALARYRRLAGGASSAGAHTVPASTGADAALA

SEQ ID NO: 81 - protein, 682 aa, Burkholderia ambifaria
MIRRMNKPAPSPWSALDAAIARGRDALMRLQQPDGSWCFELESDATITAEYILMMHFMDKIDDARQEKMARYLRAIQRLDTHGGWDLYVDGDPDVSCSVKAYFALKAAGDSEHAPHMVRARDAILALGGAARSNVFTRILLATFGQVPWRAAPFMPIEFVLFPKWVPISMYKVAYWTRTTMVPLLVLCSLKAHARNPRNIAIPELFVTPPDQERHYFPPARGMRRAFLALDRVVRHAEPLLPKRLRQRAIRHAQAWCAERMNGEDGLGGIFPPIVYSYQMMDVLGYPADHPLRRDCENALEKLLVTRPDGSMYCQPCLSPVWDTAWSTMALEQARGVAVHEAGAPASALDELDARIARAYDWLAERQVNDLRGDWIENAPADTQPGGWAFQYANPYYPDIDDSAVVTAMLDRRGRTHRNADGTHPYAARVARALDWMRGLQSRNGGFAAFDADCDRMYLNAIPFADHGALLDPPTEDVSGRVLLCFGVTKRADDRASLARAIDYVKRTQQPDGSWWGRWGTNYLYGTWSVLAGLALAGEDPSQPYIARALAWLRARQHADGGWGETNDSYIDPALAGTNAGESTSNCTAWALLAQMAFGDGESESVKRGIAYLQSVQQDDGFWWHRSHNAPGFTRIFYLKYHGYTAYFPLWALARYRRLAGGASSAGAHAVPASTAADAALA

SEQ ID NO: 82 - protein, 678 aa, Burkholderia ambifaria
MNKPAPSPWSALDTAIARGRDALMRLQQPDGSWCFELESDATITAEYILMMHFMDKIDDVRQEKMARYLRAIQRLDTHGGWDLYVDGDPDVSCSVKAYFALKAAGDSEHAPHMVRARDAILALGGAARSNVFTRILLATFGQVPWRATPFMPIEFVLFPKWVPISMYKVAYWARTTMVPLLVLCSLKARARNPRNIAIPELFVTPPDEERHYFPPARGMRRAFLALDRVVRHVEPLLPKRLRQRAIRHAQAWCAERMNGEDGLGGIFPPIVYSYQMMDVLGYPDDHPRRRDCENALEKLLVTRTDGSMYCQPCLSPVWDTAWSTMALEQARAVAVPEAGARASALDELDARIARAYDWLAERQVNDLRGDWIENAPADTQPGGWAFQYANPYYPDIDDTAVVTAMLDRRGRTHRNADGSHPYAARVARALDWMRGLQSRNGGFAAFDADCDRMYLNAIPFADHGALLDPPTEDVSGRVLLCFGVTKRAADRASLARAIDYVKRTQQPDGSWWGRWGTNYLYGTWSVLAGLALAGEDPSQPYIARALAWLRARQHADGGWGETNDSYIDPTLAGTNAGESTSNCTAWALLAQMAFGDCESESVRRGIAYLQSVQQDDGFWWHRSHNAPGFPRIFYLKYHGYTAYFPLWALARYRRLASGVSSAGVHAVPASTGADAALA

SEQ ID NO: 83 - protein, 657 aa, Burkholderia ambifaria
MNDLTEMATLSAGTVPAGLDAAVASATDALLAAQNADGHWVYELEADSTIPAEYVLLVHYLGETPNLELEQKIGRYLRRVQQADGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPIAKNPRGVRIDELFVDPPVNAGLLPRQGHQSPGWFAFFRVVDHVLRAADGLFPSYTRERAIRQAVSFVDERLNGEDGLGAIYPAMANAVMMYDVLGYAEDHPNRAIARKSIEKLLVVHEDEAYCQPCLSPVWDTSLAAHALLETGDARAEEAVIRGLEWLRPLQILDVRGDWISRRPHVRPGGWAFQYANAHYPDVDDTAVVAVAMDRVQKLKHNDTFRDSIALAREWVVGMQSSDGGWGAFEPENTQYYLNNIPFSDHGALLDPPTADVSGRCLSMLAQLGETPLNSEPARRALDYMLKEQEPDGSWYGRWGMNYVYGTWTALCALNAAGLTPDDPRVKRGAQWLLSIQNKDGGWGEDGDSYKLNYRGFEQAPSTASQTAWALLGLMAAGEVNNPAVARGVEYLIAEQKEHGLWDETRFTATGFPRVFYLRYHGYRKFFPLWALARYRNLKRDNATHVTFGL

SEQ ID NO: 84 - protein, 687 aa, Burkholderia cenocepacia
MIRRMNQSAPSSWSALDAAIARGRDALVRLQQPDGSWCFELESDATITAEYILMMHFMDRIDDVRQEKMARYLRANQRLDTHGAWDLYVDGAPDVSCSVKAYFALKAAGDSEHAPHMIRARDAILKLGGAARSNVFTRILLATFGQVPWRAAPFMAVEFVLFPKWVPISMYKVAYWARTTMVPLLVLCSLKARARNPRNVSIRELFVTPPEQERHYFPPARGMRRLFLALDRTVRPIEPLLPKRLRQRAIRHAEAWCAERMNGEDGLGGIFPPIVYSYQMMQVLGYPDDHPLRRDCENALEKLLVTRPDGSMYCQPCLSPVWDTAWSTMALEQARGVAAPETGDTATGAPRDLDGRIARAYDWLATRQVNDLRGDWIENAPADVEPGGWAFQYANPYYPDIDDTALVTAMLDRRGRTHRAADGTHPYASCVSRALDWMRGLQSRNGGFAAFDADCDRMYLNAIPFADHGALLDPPTEDVSGRVLLCFGVTKRAADRASLARAIDYVKRTQQPDGSWWGRWGTNYLYGTWSVLAGLALAGEDKSQPYIARALDWLRARQHADGGWGETNDSYLDPKLAGTNGGESTSNCTAWALLAQMAFGDCESDSVKRGIAYLQSVQQEDGFWWHRSHNAPGFPRIFYLKYHGYTAYFPLWALARYRRLAGAKDAGATRSGASGASATSVTDDALA

SEQ ID NO: 85 - protein, 684 aa, Burkholderia cenocepacia
MIRRMNKSAPSPWSALDAAIARGRDALVRLQQPDGSWCFELESDATITAEYILMMHFMDRIDDVRQERMARYLRANQRLDTHGAWDLYVDGAPDVSCSVKAYFALKAAGDSEHAPHMIRARDAILKLGGAARSNVFTRILLATFGQVPWRAAPFMPIEFVLFPKWVPISMYKVAYWARTTMVPLLVLCSLKARARNPRNVSIRELFVTPPEQERHYFLPARGMRRLFLALDRTVRPIEPLLPKRLRQRAIRHAEAWCAERMNGEDGLGGIFPPIVYSYQMMQVLGYPDDHPLRRDCENALEKLLVTRPDGSMYCQPCLSPVWDTAWSTMALEQARGVAAPETGDTASGALRELDERIARAYDWLATRQVNDLRGDWIENAPADVEPGGWAFQYANPYYPDIDDTALVTAMLDRRGRTHRGADGTHPYASRVARALDWMRGLQSRNGGFAAFDADCDRMYLNAIPFADHGALLDPPTEDVSGRVLLCFGVTKRAADRASLAHAIDYVKRTQQPDGSWWGRWGTNYLYGTWSVLAGLALAGEDKSQPYITRALDWLRARQHADGGWGETNDSYIDPKLAGTNDGESTSNCTAWALLAQMAFGDCESDSVKRGIAYLQSVQQEDGFWWHRSHNAPGFPRIFYLKYHGYTAYFPLWALARYRRLAGAKDADATRSPASATPATDNALA

SEQ ID NO: 86 - protein, 679 aa, Burkholderia cenocepacia
MIRRMNKSAPSPWSTLDTAIARGRDALVRLQQPDGSWCFELESDATITAEYILMMHFMDRIDDVRQEKMARYLRANQRLDTHGAWDLYVDGAPDVSCSVKAYFALKAAGDSEQAPHMIRARDAILKLGGAARSNVFTRILLATFGQVPWRAAPFMPIEFVLFPKWVPISMYKVAYWARTTMVPLLVLCSLKARARNPRNVSIRELFVTPPEQERRYFPPARGMRRLFLALDRAVRHIEPLMPKRLRQRAIRHAQAWCAERMNGEDGLGGIFPPIVYSYQMMQVLGYPDDHPLRRDCENALEKLLVTRPDGSVYCQPCLSPVWDTAWSTMALEQARGVAAPETGETAAGTLRELDERIARAYDWLAARQVNDLRGDWIENVPADVEPGGWAFQYANPYYPDIDDSALVTAMLDRRGRTHRHADGTNPYAPRVARALDWMRGLQSRNGGFAAFDADCDRMYLNAIPFADHGALLDPPTEDVSGRVLLCFGVTKRAEDRASLARCIDYVKRTQQPDGSWWGRWGTNYLYGTWSVLAGLALAGEDKSQPYIARALDWLRARQHADGGWGETNDSYLDPTLAGTNGGESTSNCTAWALLAQMAFGDCESDSVKRGIAYLQSVQQEDGFWWHRSHNAPGFPRIFYLKYHGYTAYFPLWALARYRRLAGAAAAPPAALVAADTALA

SEQ ID NO: 87 - protein, 657 aa, Burkholderia cenocepacia
MNDLTEMATLSAGAVPAGVDAAVARATDALLAAQQADGHWVYELEADSTIPAEYVLLVHYLGETPNLELEQKIGKYLRRIQQADGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPLAKNPRGVRIDELFIDPPVNAGLLPRQGHQSPGWFAFFRVVDHALRAVDGLFPSYTRERAIRQAVSFVDERLNGEDGLGAIYPAMANSVMMYAALGYAEDHPNRAIARKSVEKLLVVHDDEAYCQPCLSPVWDTSLAAHALLETGDARAQEAVLRGLEWLRPLQILDVRGDWISRRPNVRPGGWAFQYANAHYPDVDDTAVVVMAMDRAQKLTQSDTYRESMARAREWVVGMQSSDGGWGAFEPENTQYYLNNIPFSDHGALLDPPTADVSGRCLSMLSQLGETPLNSEPARRALDYMLKEQEPDGSWYGRWGMNYVYGTWTALCSLNAAGLTPDDPRMKRGAQWLLSIQNKDGGWGEDGDSYKLNYRGYEQAPSTASQTAWALLGLMAAGEVNNPAVARGVDYLVAQQNEEGLWDETRFTATGFPRVFYLRYHGYRKFFPLWALARYRNLKRANATRVTVGM

SEQ ID NO: 88 - protein, 658 aa, Burkholderia dolosa
MNDLTDMATLSAGAAPAADLDAAVARATDALLAAQNADGHWVYELEADSTIPAEYVLLVHYLGETPNLELERKIGRYLRRIQQADGGWPLFTDGAPNVSASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPLAKNPRGVRIDELFIDPPVNAGLLPRQGHQSAGWFAFFRVVDHVLRAVDGLFPKYTRERAIRQAVSFVDERLNGEDGLGAIYPAMANAVMMYDVLGYAEDHPNRAIARKSIEKLLVVHDDEAYCQPCLSPVWDTSLAAHALLETGDPRAEDAALRGLEWLRPLQILDVRGDWISRRPNVRPGGWAFQYANAHYPDVDDTAVVAMAMDRAQKLRQSDTYRESIARAREWVVGMQSSDGGWGAFEPENTQYYLNNIPFSDHGALLDPPTADVSGRCLSMLSQLGESALTSEPARRALDYMLKEQEPDGSWYGRWGMNYVYGTWTALCALNAAGLGPDDPRVKRAAQWLLSIQNKDGGWGEDGDSYKLNYRGYEQAPSTASQTAWALLGLMAAGEVNNPAVARGIDYLLAEQKEHGLWDEVRFTATGFPRVFYLRYHGYRKFFPLWALARYRNLKRANATRVTVGM

SEQ ID NO: 89 - protein, 776 aa, Burkholderia glumae
MNDLTNSSAPGARPDDATPSAAGPTPAEAAGGAVAPSRAVQPADTQTAATGAAGAAAAVGATPAELAATAPASSGTPAGASAAPAPSGTPSVDAPAELASAAPAPSGATPAATATAATAPAPARAASIDAPALAAADLDAAITRATDALLAAQQADGHWIYELEADSTIPAEYVLLVHYLGETPNLELERKIARYLRRVQLPGGGWPLFTDGAPDVSASVKAYFALKMIGDDANAEHMVRARNAIHAMGGAEMSNVFTRIQLALFGVVPWFAVPMMPVEIMLLPQWFPFHLSKVSYWARTVTVPLLVLSAKRPLARNPRGVRVDELFVAPPVNAGLLPRAGHQSPAWFACFRLLDGLLRLTDGLFPRYTRERAIRQALQFVDERLNGEDGLGAIYPAMANSVMMYAALGYPEDHPNRATARRAIEKLLVIHDDEAYCQPCLSPVWDTSLAAHALLETGEPRAEAAAIRGLDWLRPLQILDVRGDWISRRPDVRPGGWAFQYANPHYPDVDDTAVVTLAMDRVAKLAQTDAYRDAIARAREWVVGMQSSDGGWGAFEPENTHQYLNSIPFSDHGALLDPPTADVSGRCLSMLAQLGETAANSAPARRALDYLLAEQGADGSWYGRWGMNYIYGTWSALGALNAAGLPFDDPRVKRAAQWLLSIQNPDGGWGEDGDSYKLDYRGYERAASTASQTAWALLGLMAAGEVEHPAVARGIAWLAAQQREHGLWDEARFTATGFPRVFYLRYHGYRKFFPLWALARYRNLRRTGTRRVTVGM

SEQ ID NO: 90 - protein, 676 aa, Burkholderia glumae
MIRPMKNSDLPLPSLLDAAILRGRDALAQRQSADGSWCFELESDATITAEYILMMHFMGKIDEARQARMARYLRGIQRLATHGAWDLYVDGAPDVSCSVKAYFALKAAGDSEDAPHMARARETILKLGGAAKSNVFTRILLATFGQVPWRATPFMPVEFVLFPKWVPISMYKVAYWARTTMVPLLVLCSLKARAKNPRNVSIRELFVTAPEAERHYFARGGFVRNLFLGIDRALRPLDALIPKALRRRAIRHAEAWCAERMNGEDGMGGIFPPIVYSYQMMDVLGYPEDHPLRRDCENALDKLLVERPDGSVYCQPCLSPVWDTAWSTMALEQARAVPDPRDAPPVSDAQLQRCIAASYEWLAGKQVTQVRGDWVENAPAATPAGGWAFQYENPYYPDIDDSAVVAAMLHRRGRLLARSTGTDPYAQVVARGLDWMRGLQSRNGGFGAFDADCDRLYLNLIPFADHGALLDPPTEDVSGRVLLCLGVTGRDEDKPALARAIEYVKRMQRADGCWWGRWGTNYIYGTWSVLAGLALAGENPSQPYIARAIAWLRACQNADGGWGETNDSYLDPALAGTNGGESASNVTAWALLAQMAFGDWQSESVQRGIRYLLSVQQADGFWWHRSHNAPGFPRIYYLKYHGYTAYFPLWALARYRRLSQAGAARDVTDGAALAAS

SEQ ID NO: 91 - protein, 683 aa, Burkholderia graminis
MNDLSQAHVLGAAMPETAGEAQNAQAAANSAAAAAEASAVLAPSLDAAITRATDAILAAQKPDGHWVYELEADATIPAEYVLLVHYLGETPNVELEQKIARYLRRIQLPNGGWPLFTDGAIDISASVKAYFALKMIGDPVDAEHMVRAREAILAHGGAETVNVFTRILLALFGVVSWRAVPMMPVEITLLPMWFPFHLSKVSYWARTVIVPLLVLNAKRPLARNPRRVRIDELFRGAPVNTGMPARAPHQHVGWFGFFRVVDTVLRAVDGLFPKATRERAVREAVAFVDQRLNGEDGLGAIFPAMANSVMMYDVLGYPADHPNRAIARRSIEKLLVIKDDEAYCQPCLSPVWDTSLAAHALLETGDARAEQAAERGLAWLRPLQILDVRGDWISRRPNVRPGGWAFQYNNAYYPDVDDTAVVAMAMHRSEALTHSGADREAIARAREWVVGMQSSDGGWGAFEPENTQYYLNNIPFSDHGALLDPPTADVSGRCLSMLAQLGEFPQNSEPAQRALDYMLKEQEADGSWYGRWGLNYIYGTWTALCSLNAAGLPHDDPRIRRAAQWLLSIQNEDGGWGEGGESYKLDYRGYERAPSTASQTAWALMGLMAAGEVDHEAVARGIEYLQREQREHGLWDETRFTATGFPRVFYLRYHGYRKFFPLWALARYRHLKRNGLTRVAVGM

SEQ ID NO: 92 - protein, 657 aa, Burkholderia mallei
MNDMTEMHTLDATAAPAGLDAAVARATDALLAAQQADGHWVYELEADSTIPAEYVLLVHYLGEAPNVELEQKIARYLRRIQQPDGGWPLFTDGAPNISASVKAYFALKVIGDDENAEHMQRARRAIHAMGGAEMSNVFTRIQLALYGVVPWYAVPMMPVEIMLLPQWFPFHLSKVSYWARTVIVPLLVLNAKRPVAKNPRGVRIDELFKGAPVSTGLLPKQPHQSAGWFAFFRAVDGVLRLVDGLFPRYTRERAIRQAVAFVDERLNGEDGLGAIYPAMANAVMMYAALGYPEDHPNRAIARRSIEKLLVVGEQEAYCQPCLSPVWDTSLAAHALLETGDARAREAAVRGLDWLVPRQILDVRGDWISRRPHVRPGGWAFQYANAHYPDVDDTAVVAMAMDRVAKLDRTDAYRESIARAREWVVGMQSSDGGWGAFEPENTQYYLNNIPFSDHGALLDPPTADVSGRCLSMLAQFGETSASSEPARRALDYMLKEQEPDGSWYGRWGMNYIYGTWTALCSLNAAGLGHDDPRVKRAAQWLLSIQNADGGWGEDGDSYKLDYRGYERAPSTSSQTAWALLGLMAAGEVDNPAVARGVDYLLGTQREHGLWDETRFTATGFPRVFYLRYHGYRKFFPLWALARYRNLKRANAMRVTVGM

SEQ ID NO: 93 - protein, 683 aa, Burkholderia multivorans
MIRAMNKSALSPWSALDTAIARGRDALARLQQPDGSWCFELESDATITAEYILMMHFMDRIDDALQERMARYLRAIQRLDTHGAWDLYVDGAPDVSCSVKAYFALKAAGDSEHAPHMIRAREAILKLGGAARSNVFTRILLATFGQVPWRATPFMPIEFVLFPKWVPISMYKVAYWARTTMVPLLVLCSLKARARNPRNVAIPELFVTPPDQERHYFPPTRGMRRAFLILDRVVRHVEPLLPKRLRRRAIRHAEAWCAQRMNGEDGLGGIFPPIVYSYQMMDVLGYPEDHPLRRDCENALAKLLVTRPDGSVYCQPCLSPVWDTAWSTMALEQARSVAVPESDESARALDELDARIARAYDWLATRQVNDLRGDWIENAPADTQPGGWAFQYANPYYPDIDDSAVVTAMLDRRGRTHRNADGSHPYAARVARALDWMRALQSRNGGFAAFDADCDRLYLNAIPFADHGALLDPPTEDVSGRVLLCFGVTRRAEDRASLARAIDYVKRTQQPDGSWWGRWGTNYLYGTWSVLAGLTLAGEDPSQPYIARALEWLRAHQHADGGWGETNDSYLDPALAGTNGGESTSNCTAWALLAQMAFGDCASDSVKRGIAYLQSVQQDDGFWWHRSHNAPGFPRIFYLKYHGYTAYFPLWALARYRRLAGAAEARARASSGRAPHAADTALA

SEQ ID NO: 94 - protein, 657 aa, Burkholderia multivorans
MNDLTDMATLSAGTVPAELDAAVARATDALLAAQNADGHWVYELEADSTIPAEYVLLVHYLGETPNLELEQKIGRYLRRIQQADGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPLAKNPRGVRIDELFIDPPVNAGLLPRQGHQSAGWFAFFRAVDHVLRAVDGLFPAYTRERAIRQAVAFVDERLNGEDGLGAIYPAMANAVMMYDVLGYAEDHPNRAIARKSIEKLLVVHEDEAYCQPCLSPVWDTSLAAHALLETRDPRAEQAAVRGLDWLRPLQILDVRGDWISRRPHVRPGGWAFQYANPHYPDVDDTAVVAMAMDRAQKLNQSDTYRESIARAREWVVGMQSSDGGWGAFEPENTQYYLNNIPFSDHGALLDPPTADVSGRCLSMLSQLGETALNSDAARRALDYMLKEQEPDGSWYGRWGMNYVYGTWTALCALNAAGLGPDDARVKRAAQWLLSIQNKDGGWGEDGDSYKLNYRGYEPAPSTASQTAWALLGLMAAGEVNNPAVKRGIDYLIAEQKEHGLWDEARFTATGFPRVFYLRYHGYRKFFPLWALARYRNLKRDNTTRVTVGI

SEQ ID NO: 95 - protein, 668 aa, Burkholderia oklahomensis
MNDMTEMHTLDAAAAPAADAPAVTAVTAGLDAAVARATDALLAAQNADGHWVYELEADSTIPAEYVLLVHYLGEEPNAELEQKIARYLRRIQQPDGGWPLFTDGAPNVSASVKAYFALKVIGDDENAEHMQRARRAIHAMGGAETSNVFTRIQLALYGVVPWYAVPMMPVEVMLLPQWFPFHLSKVSYWARTVIVPLLVLNAKRPVAKNPRGVRIDELFKSAPVNTGLLPKQPHQSTGWFAFFRAVDGVLRLVDGLFPRYTRERAIRQAVAFVDERLNGEDGLGAIYPAMANAVMMYAALGYPEDHPNRAIARQSIEKLLVVGEEEAYCQPCLSPVWDTSLAAHALLETGDERARDAAVRGLDWLIPRQILDVRGDWISRRPHVRPGGWAFQYANPHYPDVDDTAVVVMAMDRVAKLDQSDAYREQIARAREWVVGMQSSDGGWGAFEPENTQYYLNNIPFSDHGALLDPPTADVSGRCLSMLAQLGETNASSEPARRAFDYMLKEQEPDGSWYGRWGMNYIYGTWTALCALNAAGLGHDDPRVKRAAQWLLSIQNQDGGWGEDGESYKLDYRGYERAPSSSSQTAWALLGLMAAGEVDNPVVARGIDYLLGAQCEHGLWDETRFTATGFPRVFYLRYHGYRKFFPLWALARYRNLKRANTTRVTVGM

SEQ ID NO: 96 - protein, 677 aa, Burkholderia phymatum
MNDLSMTQTLGEVLPQTLIDDHAPVAAALATGAAPVDALDAAVTRATEAILAVQKDDGHWVYELEADATIPAEYVLLVHFLGETPNLELEQKIARYLRRIQLPNGGWPLFTDGAMDVSASVKAYFALKMIGDPEDAAHMVRARECILANGGAEAANVFTRILLALFGVVTWYAVPMMPVEIMLLPKWFPFHLSKVSYWARTVIVPLLVLNAKRPVARNPRGVRIDELFRGAPVTTGLLPRSGHQSKSWFAFFRAVDGVLRVTDGLFPKASRERAIKAAVSFVDERLNGVDGLGAIFPAMANSVMMYDVLGYPADHPNRAIARESIEKLLVVHEDEAYCQPCLSPVWDTSLAAHALLETGDARAEEAAERGLAWLRPLQILDVRGDWISRRPDVRPGGWAFQYNNAHYPDVDDTAVVAMAMHRSAAVTNSNVDANAIARAREWVVGMQSSDGGWGAFEPENTQYYLNNIPFSDHGALLDPPTADVSGRCLSMLAQLGEMPATSEPARRAYDYLLKEQEDDGSWYGRWGMNYIYGTWTALCALNAAGISLEDARIKRAAQWLVSIQNADGGWGEDGTSYKLDYRGYEKAPSIPSQTAWALLGLMAAGYVDHPAVARGIDYLQREQRDHGLWDEERFSATGFPRVFYLRYHGYRKYFPLWALARYRNLKRTGEKRVTVGM

SEQ ID NO: 97 - protein, 676 aa, Burkholderia phytofirmans
MNDLSQAQPLDAILPDFADAAPSAPAPAVTGEAPTASLDAAITRATEAILAAQKPDGHWVYELEADATIPAEYVLLVHYLGETPNLELEQKIARYLRRIQLPDGGWPLFTDGALDISASVKAYFALKMIGDPADAEHMVRAREAILAHGGAETVNVFTRILLALFGVVSWRAVPMMPVEIMLLPMWFPFHLSKVSYWARTVIVPLLVLNAKRPVARNPRRVRIDELFRGAPVNTGPRDRAPHQHAGWFRFFSGVDVLLRAVDGLFPKSTRERAVRQAVAFVDERLNGEDGLGAIFPAMANSVMMYDVLGYPADHPNRAIARQSIDKLLVIKDDEAYCQPCLSPVWDTSLAAHALLETGEAHAEQAAERGLAWLRPLQILDVRGDWISRRPNVRPGGWAFQYNNAHYPDVDDTAVVAMAMQRSATVTQSDVDRDAIARAREWVVGMQSSDGGWGAFEPENTQYYLNNIPFSDHGALLDPPTADVSGRCLSMLAQLGELPQNSEPAQRAFDYMLKEQESDGSWYGRWGLNYIYGTWTALCSLNAAGLPHDDPRMKRAAQWLLSIQNEDGGWGEGGESYKLDYHGYERAPSTASQTAWALMGLMAAGEVNHEAVARGVAYLEREQREHGLWDETRFTATGFPRVFYLRYHGYRKFFPLWALARFRHLKRNGLTRVAVGM

SEQ ID NO: 98 - protein, 657 aa, Burkholderia pseudomallei
MNDMTEMHTLDATAAPAGLDAAVARATDALLAAQQADGHWVYELEADSTIPAEYVLLVHYLGEAPNVELEQKIARYLRRIQQPDGGWPLFTDGAPNISASVKAYFALKVIGDDENAEHMQRARRAIHAMGGAEMSNVFTRIQLALYGVVPWYAVPMMPVEIMLLPQWFPFHLSKVSYWARTVIVPLLVLNAKRPVAKNPRGVRIDELFKGAPVSTGLLPKQPHQSAGWFAFFRAVDGVLRLVDGLFPRYTRERAIRQAVAFVDERLNGEDGLGAIYPAMANAVMMYAALGYPEDHPNRAIARRSIEKLLVVGEQEAYCQPCLSPVWDTSLAAHALLETGDARAREAAVRGLDWLVPRQILDVRGDWISRRPHVRPGGWAFQYANAHYPDVDDTAVVAMAMDRVAKLDRTDAYRESIARAREWVVGMQSSDGGWGAFEPENTQYYLNNIPFSDHGALLDPPTADVSGRCLSMLAQFGETSASSEPARRALDYMLKEQEPDGSWYGRWGMNYIYGTWTALCSLNAAGLGHDDPRVKRAAQWLLSIQNADGGWGEDGDSYKLDYRGYERAPSTSSQTAWALLGLMAAGAVDNPAVARGVDYLLGTQREHSLWDETRFTATGFPRVFYLRYHGYRKFFPLWALARYRNLKRANATRVTVGM

SEQ ID NO: 99 - protein, 681 aa, Burkholderia sp.
MNDLSQTQPLAAVLPEAADAPAVADASATAAPEPVQAASPSALDASITRATDTILAAQKPDGHWVYELEADATIPAEYVLLVHYLGETPNLELEQKIARYLRRIQLPNGGWPLFTDGALDISASVKAYFALKMIGDPVDAEHMVRARDAILAHGGAERANVFTRILLALFGVVSWRAVPMMPVEIMLLPVWFPFHLSKVSYWARTVIVPLLVLNAKRPLARNPRKVRIDELFRAAPVNTGMNERAPHQHAGWFGFFRCVDTVLRAVDGLLPKATRERAIRAAVAFVDERLNGEDGLGAIFPAMANSVMMYDVLGYPADHPHRAIARKSLDKLLVIKDDEAYCQPCLSPVWDTSLAAHALLETGEARAEQAAERGLAWLRPLQILDVRGDWISRRPNVRPGGWAFQYNNAHYPDVDDTAVVAMAMHRSAALTQSDVDREAIARAREWVVGMQSSDGGWGAFEPENTQYYLNNIPFSDHGALLDPPTADVSGRCLSMFAQIGELPQSSEPARRAFDYMLQEQEPDGSWYGRWGLNYIYGTWTALSSLNAAGMPHDDPRMRRAAQWLVSIQNEDGGWGEGGESYKLDYHGYERAPSTASQTAWALLGLMAAGEVNHEAVARGIDYLQREQREHGLWDETRFSATGFPRVFYLRYHGYRKFFPLWALARFRHLKRHGLTRVTVGM

SEQ ID NO: 100 - protein, 678 aa, Burkholderia sp.
MIRRMTTPTPSPWSALDTAIARGRDALVRLQQPDGSWCFELESDATITAEYILMMHFMDKIDDLRQEKMARYLRANQRLDTHGGWALYVDGDPDVSCSVKAYFALKAAGDSEHAPHMVRARDAILKLGGAARANVFTRILLATFGQVPWRAAPFMPIEFVLFPKWVPISMYKVAYWARTTMVPLLVLCSLKARARNPRNISIRELFVTPPDEERQYFPPARGMRKLFLALDRTVRHVEPLMPKGLRQRAIRHAEAWCAERMNGEDGLGGIFPPIVYCYQMMEVLGYPDDHPLRRDCENALEKLLVTRPDGSMYCQPCLSPVWDTAWSTMALEQARGVAVAEDGEPGDARRALDERITRAYDWLAERQVNDLRGDWIENAPADVQPGGWAFQYANPYYPDIDDTAVVTAMLDRRGRTHANADGTNPYATRVARALDWMRGLQSRNGGFGAFDADCDRLYLNAIPFADHGALLDPPTEDVSGRVLLCFGVTKRADEHASLARCIDYVKRTQQPDGSWWGRWGTNYIYGTWSVLAGLALAGEDKSQPYIARAIEWLRARQHADGGWGETNDSYIDPKLGGTNGGESTSNFTAWALLAQMAFGDCESDSVKRGIAYLQSVQQEDGFWWHRSHNAPGFPRIFYLKYHGYTAYFPLWALARYRRLAGVANKRVSTADKTADAMA

SEQ ID NO: 101 - protein, 657 aa, Burkholderia sp.
MNDLTEMATLSAGAVPAGVDTAVARATDALLAAQNADGHWVYELEADSTIPAEYVLLVHYLGETPNLELEQKIGKYLRRIQQADGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPLAKNPRGVRIDELFIDPPVNAGLLPRQGHQSAGWFAFFRVVDHALRAVDGLFPNYTRERAIRQAVSFVDERLNGEDGLGAIYPAMANSVMMYDVLGYAEDHPNRAIARKSIEKLLVVQEDEAYCQPCLSPVWDTSLAANALLETRDARAEDAAIRGLEWLRPLQILDVRGDWISRRPHVRPGGWAFQYANAHYPDVDDTAVVAVAMERAQQLKQNDAYRDSIARAREWVVGMQSSDGGWGAFEPENTQYYLNNIPFSDHGALLDPPTADVSGRCLSMLSQLGETPLNSEPARRALDYMLKEQEPDGSWYGRWGMNYVYGTWTALCSLNAAGLTPDDPRVKRGAQWLLSIQNKDGGWGEDGDSYKLNYRGFEQAPSTASQTAWALLGLMAAGEVNNPAVARGIDYLIAEQNAEGLWDETRFTATGFPRVFYLRYHGYRKFFPLWALARYRNLKRDNTTRVTVGL

SEQ ID NO: 102 - protein, 694 aa, Burkholderia sp. CCGE1002
MNDLSQTQPLDAVLPEAADAASNLAEAAVVANAPAVADALATATPSPMQTAGASPLDVSITRATDAILAAQQPDGHWIYELEADATIPAEYVLLVHYLGETPNLELEQKIARYLRRIQLPNGGWPLFTDGALDISASVKAYFALKMIGDPVDAEHMVRARDAILAHGGAEHANVFTRILLALFGVVSWRAVPMMPVEIMLLPMWFPFHLSKVSYWARTVIVPLLVLNAKRPLARNPRKVRIDELFRGAPVNTGMNERAPHQHAGWFGFFRCVDTVLRAVDGLLPKASRERAIRAAVAFVDERLNGEDGLGAIFPAMANSVMMYDVLGYPADHPNRAIARKSLDKLLVIKEDEAYCQPCLSPVWDTSLVAHALLETREARAEQAAERGLAWLRPLQILDVRGDWISRRPNVRPGGWAFQYNNAHYPDVDDTAVVAMAMHRSAALTKSDVDREAIARAREWVVGMQSSEGGWGAFEPENTQYYLNNIPFSDHAALLDPPTADVSGRCLSMFAQIGELPQNSEPAQRAFDYMLQEQESDGSWYGRWGLNYIYGTWTALCSLNAAGMSHDDPRMRRAVQWLVSIQNEDGGWGEGGESYKLDYRGYERAPSTASQTAWALLGLMAAGEVDHDAVARGIDYLQREQREHGLWDETRFTATGFPRVFYLRYHGYRKFFPLWALARFRHLKRNGLTRVTVGM

SEQ ID NO: 103 - protein, 672 aa, Burkholderia thailandensis
MNDMTEMHTLDATAVPAAPAAADAPAPSAATTGLDAAVARATDALLAAQNADGHWVYELEADSTIPAEYVLLVHYLGEEPNAELEQKIARYLRRIQQPDGGWPLFTDGAPNISASVKAYFALKVIGDDENAEHMQRARRAIHAMGGAEMSNVFTRIQLALYGVVPWYAVPMMPVEIILLPQWFPFHLSKVSYWARTVIVPLLVLNAKRPVAKNPRGVRIDELFKSAPVNTGLLPKQPHQHAGWFAFFRAVDGVLRLADGLFPRYTRERAIRQAAAFVDERLNGEDGLGAIYPAMANAVMMYAALGYPEDHPNRAIARQSIEKLLVVGEEEAYCQPCLSPVWDTSLAAHALLETGDERAREAAVRGLDWLVPRQILDVRGDWISRRPHVRPGGWAFQYANAHYPDVDDTAVVVMAMDRVAKHDQTDAYRESIARAREWVVGMQSSDGGWGAFEPENTQYYLNNIPFSDHGALLDPPTADVSGRCLSMLAQLGETSASSEPARRALDYMLKEQEPDGSWYGRWGMNYIYGTWTALCSLNAAGLGHDDPRVKRAAQWLLSIQNPDGGWGEDGDSYKLDYRGYERAPSTSSQTAWALLGLMAAGEVDNPAVARGIGHLLGTQREHGLWDETRFTATGFPRVFYLRYHGYRKFFPLWALARYRNLKRAGAARVTVGM

SEQ ID NO: 104 - protein, 663 aa, Burkholderia thailandensis
MNDMTEMHTLDATAAPAAPTVATGLDAAVARATDALLAAQNADGHWVYELEADSTIPAEYVLLVHYLGEAPNVELERKIARYLRRIQLPDGGWPLFTDGAPNISASVKAYFALKVIGDDENAEHMQRARRAIHAMGGAEMSNVFTRIQLALYGVVPWYAVPMMPVEIMLLPQWFPFHLSKVSYWARTVIVPLLVLNAKRPVAKNPRGVRIDELFKSAPVNTGLLPKQPHQSAGWFAFFRAVDGVLRLTDGLFPRYTRERAIRQAVAFVDERLNGEDGLGAIYPAMANAVMMYAALGYPEDHPNRAIARQSIEKLLVVGEDEAYCQPCLSPVWDTSLAAHALLETGDERAREAAVRGLDWLVPRQILDVRGDWISRRPHVRPGGWAFQYANAHYPDVDDTAVVAMAMDRVAKLDRTDAYRESIARAREWVVGMQSSDGGWGAFEPENTQYYLNNIPFSDHGALLDPPTADVSGRCLSMLAQFGETSASSEPARRALDYMLKEQEPDGSWYGRWGMNYIYGTWTALCSLNAAGLGHDDPRVKRAAQWLLSIQNPDGGWGEDGDSYKLDYRGYERAPSTSSQTAWALLGLMAAGEVDHPAVARGIDHLLGTQREHGLWDETRFTATGFPRVFYLRYHGYRKFFPLWALARYRNLKRANATRVTVGM

SEQ ID NO: 105 - protein, 678 aa, Burkholderia ubonensis
MKPNHTFSPAALDAAILRGRDTLSGLQQPDGSWCFELESDATITAEYILMMHFMDKIDEVRQAQMARYLRAIQRVETHGAWDLYVDGAPDISCSVKAYFALKAAGDSEHAPHMIRAREAILKLGGAARSNVFTRILLATFGQVPWRAAPFMPVEFVLFPKWVPISMYKVAYWARTTMVPLLVLCSLRARARNPRNVSIAELFVTPPDEERHYFPPAKGMRKLFLALDRTVRHLEPLLPRRLRQRAIRHAEAWCAERMNGEDGLGGIFPPIVYSYQMMEVLGYPEDHPLRRDCEDALEKLLVTRADGSVYCQPCLSPVWDTAWSTMALEQARGATPAAPDTQVSERELDARIARAYDWLATRQVNDLEGDWRENARPGTLPGGWAFQYANPYYPDIDDSAVVTAMLDRRGRAQARASGENPYAERVTRALDWMRGLQSRNGGFGAFDADCDRLYLNAIPFADHGALLDPPTEDVSGRVLLCFGVTKRPADRAAAARAIEYVKRTQQPDGSWWGRWGTNYLYGTWSVLAGLALSGEDKSQPYIARALDWLRAHQHADGGWGETNDSYADPRLRATNYGESTSNCTAWALLAQMAFGDWQSDSVRRGIAYLLSVQQDDGFWWHRSHNAPGFPRIFYLKYHGYTAYFPLWALARYRRLAGAQAAPSSPGPGTAATIADPAVA

SEQ ID NO: 106 - protein, 657 aa, Burkholderia ubonensis
MNDLTDMPTLAADSAAADLDAAVARATDALLAAQQADGHWVYELEADSTIPAEYILLVHYLGETPNLELEQKIGRYLRRIQQPDGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPIAKNPRGVRIDELFIDPPVNAGLLPRQGHQSAGWFAFFRVVDHALRAVDGLFPSYTRERAIRQAVAFVDERLNGEDGLGAIYPAMANAVMMYDALGYPEDHPNRAIARRSVEKLLVVHDDEAYCQPCLSPVWDTSLAAHALLETGDPRAEDAVVRGLEWLRPLQILDVRGDWISRRPNVRPGGWAFQYANPHYPDVDDTAVVVMAMDRVEKLRHSDAYREAISRAREWVVGMQSSDGGWGAFEPENTQYYLNNIPFSDHGALLDPPTADVSGRCLSMLSQLGETAANSEAARRSLDYMLKEQEPDGSWYGRWGMNYVYGTWTALCSLNAAGLGPDDPRVKRGAQWLLSVQNKDGGWGEDGDSYKLDYRGYEQAPSTSSQTAWALLGLMAAGEVNHPAVARGIDYLIAEQKEHGLWDETRFTATGFPRVFYLRYHGYRKFFPLWALARYRNLKRANATRVTVGM

SEQ ID NO: 107 - protein, 657 aa, Burkholderia vietnamiensis
MNDLTDMANLSAGTVPAGLDASVARATDALLAAQNADGHWVYELEADSTIPAEYVLLVHFLGETPNLELEQKIGRYLRRIQQADGGWPLFTDGAPNVSASVKAYFALKVIGDDENAEHMQRARRAIHAMGGAEMSNVFTRIQLALFGAIPWRAVPMMPVEIMLLPQWFPFHLSKVSYWARTVIVPLLVLNAKRPLAKNPRGVRIGELFIDPPVNAGLLPRQGHQSPGWFAFFRVVDHALRAADGLFPSYTRERAIRQAVSFVDERLNGEDGLGAIYPAMANAVMMYDVLGYPEDHPNRAIARKSIEKLLVVHDDEAYCQPCLSPVWDTSLVAHALLETGDARAEQAVLRGLDWLRPLQILDVRGDWISRRPNVRPGGWAFQYANAHYPDVDDTAVVVMAMDRAQKLQNTDTYRESIARAREWVVGMQSSDGGWGAFEPENTQYYLNNIPFSDHGALLDPPTADVSGRCLSMLAQLGESALSSEPARRALDYMLKEQEPDGSWYGRWGMNYVYGTWTALCSLNAAGLGPEDPRVKRAAQWLLSIQNKDGGWGEDGDSYKLNYRGFEPAPSTASQTAWALLGLMAAGEVNHPAVERGIGYLIAQQNDEGLWDETRFTATGFPRVFYLRYHGYRKFFPLWALARYRNLKRANATRVTVGI

SEQ ID NO: 108 - protein, 678 aa, Burkholderia xenovorans
MNDLSQTQPRDAVLPEAAGAVPPASAPAPAAASEAPAASLDTAITRATDAILAAQKPDGHWVYELEADATIPAEYVLLVHYLGETPNVELEQKIARYLRRIQLPDGGWPLFTDGAPDVSASVKAYFALKMIGDPADAEHMVRAREAILANGGAEAVNVFTRILLALFGVVSWRAVPMMPVEIMLLPMWFPFHLSKVSYWARTVIVPLLVLNAKRPLARNPRRVRIDELFRGAPVNTGPRDRAPHQHAGWFRFFSGVDMLLRAVDGLFPKATRERAVRAAVAFVDERLNGEDGLGAIFPAMANSVMMYDVLGYPADHPNRAIARQSIEKLLVIKDDEAYCQPCLSPVWDTSLVAHALLETGEARAEQAAERGLAWLRPLQILDVRGDWISRRPNVRPGGWAFQYNNDYYPDVDDTAVVVMAMHRSAALTHSEVDREAIARAREWVVGMQSSDGGWGAFEPENTQYYLNNIPFSDHGALLDPPTADVSGRCLSMLAQLGELPQGSEPAQRAFAYMLKEQEPDGSWYGRWGLNYIYGTWTALCSLNAAGMPHDDPRMKRAAKWLLSIQNEDGGWGEGGESYKLDYHGYERAPSTASQTAWALMGLMAAGEVNHEAVARGVAYLQREQREHGLWDETRFTATGFPRVFYLRYHGYRKFFPLWALARFRHLKRHGLTRVAVGM

SEQ ID NO: 109 - protein, 657 aa, Candidatus Koribacter
MDDRHIQSEITFGKIDGIRERIQQAMDAAKRYLFSKQDPEGFWCGELEADTTLQSDYIVMHTLLGTGDPVKMQKAGKQILQHQNPDGGWNIYPDGPSNISAAVKAYFSLKLIGHKPDEPEMTKAREWILAHGGVTACNTFSKMYLCFFGQYDYDTVPAIPPEIVLFPNWFWFNLYEISSWSRGILVPLAICYAKKPFKKIPDEANIDELFVEGRHANLHLTWDKKPFSWRNFFLVLNNMVHFFERVHVRPLRKLAMKRAEKWMLERLEMSDGLGGIYPAILNSIIALRALGYSTDDPQVIRAMDEFEKLGIEEDDTFRMQPCMSPVWDTAYALYALGEAGVPGSDPRMQKAAEWMLKKQVTHKGDWAVKVRNVQPGGWYFEFNNEFYPDVDDTAQVILSLNHVRTSNERYQDDTVKRALDWQLAMQCKNGGWASFDKDNNKMVFQYIPFADHNAMLDPATVDITGRVLEALSHHGYSLKDKVVQRAVKFIQSEQEPDGSWFGRWGVNYIYGTMLCLRGLAAVGVDHHEPMVQQAAEWLRMVQNPDGGWGESVGSYDDPKLRGQGPSTASQTAWAVMGLLAANDLRSDSVTRGIAWLLENQKPNGSWWEKWITGTGFPRVFYLKYTMYAEYFPLIAFAEYLRRLNTPLDEKVKLGPQA

SEQ ID NO: 110 - protein, 488 aa, Candidatus Kuenenia
MILFPAGFYFSIYEISYWSRCIVVPLSIAIARKPHVTVGDDLLKELYLVPREDVVYRIERDQDGFCWYNFFIDADSIFRRYEQHPIKFIRRIAKKMAEKWLLEHMEKSGGLGAIWPAMINSIFAMKCLDYPDDHPALTAQMKEVEALVIYEGDMLYLQPCVSPVWDTAWSIIAMNDSGIPGSHPVLQKAGKWLLSKEVRDFGDWKLKCKVEEPSGWYFQYANEFYPDTDDTGAVLMALQRVSLPEDMHKEKTLLRALRWLQAMQCDDGGWGAFDRNNNKTILNNIPFADFNALLDPSTSDVTGRCIEFFGRIGFNKTYLNIKKAVEFLKKEQDEDGSWFGRWGSNYIYGTWSVISGLIAVGEDINKAYIKKAIAWLKSVQNSDGGWGETIKSYEDSALKGIGKSTPSQTAWALLTLITAGEIKSSSTERGIDFLLSTQKEDGSWDEREFTATGFPKVFYLKYHMYRNYFPLMALGRYRHFTHKLATSQ

SEQ ID NO: 111 - protein, 641 aa, Candidatus Solibacter
MSYEWTEPVRPGRRHAVSPVQNFCQSLAPAIQRACDALFSQQAADGFWCGELTADTTLESDYILLQLWLNQPDDHGWNPPTRPRIDRAGRSILERQLPDGGFNIYAGGPSEVSATIKAYCALKLAGLDPHSPPLRRARERILALGGLQAANSYVKINLSLFGLYPRKHVPSVPPEIVMLPGNVLYEMSSWTRSILVPLSIVQARGSNRRAPNGFNLDELLLPGVKLALPKRKGLAVLFHHLDRMFKVWEKRGSERIRGAAIREAERWLIARTHYTEGLGAIYPAMMYFIMALDALGYAEDHPDRSEAIRHFESLLIETDDRFLFQPCVSPVWDTAICAFALGEAGNTDDPRMTLAADWLISKEVRRKGDWSIKRPDTEPSGWAFEFANEFYPDIDDTAMVLLALMHANGSNPEAQAAAERRAVNWLLAMQSSDGGWAAFDVDNNWAMLNQVPFADHNAMLDPTCPDITGRVLECLCRRGMAGHDAARRGVAYLLQAQEKDGSWYGRWGVNYIYGSFLAMRGLTTSGAPGSQDAVDRAARWLRAIQNPDGGWGESCASYARDGYVAAPSSASQTAWALLGLCAAGDRDSAQFRRGVEYLLTLQAPDGKWPEGATTGTGFPNVFYLTYAMYRDYFPLLALSQV

SEQ ID NO: 112 - protein, 641 aa, Candidatus Solibacter
MSAPSHVGNTLEHAAELATRKAMAYLTCLQERDGHWCAELTADTTLESDYILFQLWLYPPQDGKWEPETRPLIRKAVNSILERQLPDGGFNICVGGPSEVSASVKAYVAMKLAGLPPEDDRMARLRERILALGGIQAANSYVKVNLSLFDLYPREFSPSIPPEVALLPFDLLYQMSAWTRAIVISLGIVHAANPRRPAPAGFNLQELWLPGVSPEFRRDPSFFTWHNTFLTVDKALKLWERYGSKAVRRRAVEKAKTWMIERLHHSDGLGAIYPPMMYSVMALDVLGYAKDDPLRVEALRHFNNLMVDDGDRFFFQPCFSPVWDTAIGAYALVQADPSHEAIAPAADWLIAKEVRRKGDWSVKRPNTEPSGWAFEYSNEYYPDIDDTAMVMLALGETRASNTEAQAAACKRGLAWLLAMQSSDGGWAAFDADNNWEFLSQVPFADHNAMLDPTCADITGRVLEALASQGLDRNHKAVRRGAEWLIRHQENDGSWYGRWGVAYIYGTCFALRGLAASGENDREAHILRAGEWLRSIQNADGGWGESCKSYDNRIFTGGPSTPSQTAWAILGLIAGGDANSLSVQHGIEYLLETQRSDGSWDEQFATGTGFPRVFYLNYHMYKDYFPLLALASFVKARAGSNG

SEQ ID NO: 113 - protein, 644 aa, Catenulispora acidiphila
MTDVIDKAVAATGPADPSQGAAATLQAAADHLLGLQDDAGWWKGELETNVTMDAEDLLLRQFLGIRTEEVTREAGDWIRSQQRADGTWANFFDGPADLSTTIEAYTALRMAGDAKDAEHMRAARTYILDSGGIEASRVFTRIWLALFGEWQWSDLPVMPPELIYLPKWFPLNVYDWACWARQTVVPLTIVNALRPVRPLGFDLKELRTGRRAPAQRGLFSTLDRALHVYERKPLRSVRDAALRRSADWIIARQEADGSWGGIQPPWVYSLMALNLLGYGVDHPVMRKGIEGLDRFTIRDERGRRLEACQSPVWDTVLAMTALRDAELPENHPALVKAADWVLGEEITNPGDWSVRRPRVAPGGWAFEFDNDGYPDVDDTAEVVLALNRVAHPDAPAAIRRGVDWLEGMACKDGGYGAFDADNTRTLALKLPFCDFGAVIDPPTADVTAHTLEAYAALGLANSRASQRALEWLVKAQERDGSWFGRWGANHVYGTGAVVPAMVAVGVDPEDEMIRRAVRWLEEHQNDDGGWGEDLRSYRDKSWIGRGVSTASQTAWALLALLAAGEERGTAVEQGVRFLIRTQRADGTWDEDHYTGTGFPGDFYLNYHLYRLVFPISALGRYVRAVGAAGDGGDAGHAGHAGTVS

SEQ ID NO: 114 - protein, 657 aa, Chthoniobacter flavus
MIFTDTPTGSTQNRLDVAIRRAQQNLLRLQHNEGYWCGELFVDSTLCSDYVLFMHWADEIDPVMEEKCVAHIRRRQLEDGGWNIYEGGPSDVNATVKAYFALKLAGHAPTQPWMQEARACILRLGGIPKMNTYAKLYLALLGQFPWRYLPTVPVEIMFMPRWFFFDIYEVSSWSRAMLMPLAILNHYKPTKHLPADKQLHELYPIGSEESDLGLGMQKPRFSWPNFFLFCDRLIKIMHSLPWKPWKRAALARAEAWMTQRMGEGSDGLAAIFPAMLNSMIALRTLRYSREHPLYVKAKNDFAGLFVDDPQDFRIQPCLSPVWDTAINLVALLESGLDPHDPKIEAAVNWLKEKEVRINGDWYVKNHHVPPSGWAFEFNNVYYPDTDDTMMVLAALARAGAHEESAPVETKAMFERALKWLLSFQCRDGGWAAFDKDVTQGWLEDVPFADHNAILDPTCSDLTGRVLELLGLIDYDRNCTPVRRALKFLRDTQEDDGSWYGRWGVNYIYGTWQVLRGLRSIGEDMRQQWIVRARDWLESCQNEDGGWGETCASYDDPTLKGKGPSTASQTAWALMGLIAAADPTEPGAFDRKSIRQGVDYLLSTQVADGSWVEPEVTGTGFPRVFYLRYDMYRNNFPLMALATYRKAREGKLPVRQRE

SEQ ID NO: 115 - protein, 603 aa, Chthoniobacter flavus
METLSRSRLEAALAKATQALLTELNPAGHWSGELSSSALSTATAIVALGAVDREQQRELIAGGMRWLAQHQNADGGWGDTVKSRSNISTTALCWAAVSTSTEHAESAAKAEAWLTRAAGSMAQLVPAIEARYGKDRTFSVPILMHLAICGRVSWSQIPALPFELAALPHQLFGALQLPVVSYALPALIAIGQAIHHHAPPTNPLLNGLRKSARARTLEVLESIQPQNGGFLEATPLTSFVTMALASAGEAQHPVARRGVSFLQASVQRDGSWAIDTNLATWVTTLSIKALAHQPGALSPERALTLREWLLGQQYVVEHPYTHAAPGGWAWTDLPGGVPDADDTPGALLALLHLGVVDAPTRQAGQIGVRWLLDLQNRDGGIPTFCRGWGALPFDRSSPDLTAHTLRAWTAWLPQLDESLKRRTLRAVTKAIHFLATHQRTDGSWLPLWFGNEHAPDDENPLYGTAKVVIALRELLNRDFTLPNGMLERALCWLVERQDISGGWSGAKNGPVSVEETALAVEALAGTGHVSATDRGAAWLTEQIEADTWREPAPIGFYFAKLWYYERLYPQIWTVGALGRVAALRVGESESDTPAGLHRATSET

SEQ ID NO: 116 - protein, 645 aa, Crocosphaera watsonii
MQTQDRLTQKQPLSLKDAITASQNYLLSLQYPQGYWWAELESNITLTAETVLLHKIWGTDKTRPLHKVEAYLRQQQREHGGWELFYGDGGEISTSVEAYMALRLLGVPQDDPALIRAKDFIISKGGISKTRIFTKFHLALIGCYDWKGIPSIPPWIMLFPDSFPFTIYEMASWARESTVPLIIVFNDKPVFSVDPVFNLDELYAEGVENVKYELPKNNNWGDIFLGIDQVFKFAEQVDLVPFRKEGLKAAEKWILNHQQETGDWGGIMPPMLNSLLAFRTLNYDVNDPSVKLGFEAIDRFSIEEDDTYRLQACVSPIWDTAWCVRALTDSGLEKDHFSLVKAGKWLLDKQVMEYGDWAVKNKAGKPGGWAFEFTNRFYPDLDDSATVVMALNGIKLPDEARKQAAINRCLQWIETMQCKEGGWAAFDLNNDQAWLNEVPYGDLKAMIDPNTADVTARVVEMLGSCDLEIESDRLNKSLNYLYKEQEKDGSWFGRWGVNYIYGTSGVLSALAVINPEKHKTQMEQGINWLLSCQNKDGGWGETCRSYNDPSLKGKGVSTPSQTAWSLIGLLDAGEALNKFETDAIERGVNYLLDTQTEEGTWEESEFTGTGFPCHFYIRYHFYRHYFPLIALGRYQNLSSEFGVRS

SEQ ID NO: 117 - protein, 681 aa, Cupriavidus taiwanensis
MNETAFANPAPQVGPAQRQPAAPQEAPAARLPAPALDRGIDRALDALLHQQRPDGHWVYELEADATIPAEYVLMVHYLGEDPDRDLEARIARYLRRIQNPDGGWPLFHQGRSDISASVKAYFALKMAGDDPQSAPMQRARQAIHAMGGAEATNVFTRTLLALYGVLPWKAVPMMPVEIMLLPRWFPFHLSKVSYWARTVIVPLLVLNSLRPQARNPRGVGINELFVGNCHTVGLPPRAAHQHAGWYTVFRGLDALLRLAEPLFPRTLRRRAIAAAQRFVRERLNGEDGLGAIFPAMANSVMMFDVLGVPPEDPARAVARRSIERLLVEHGDEAYCQPCLSPVWDTALATHALLETGEARAAQAAGRALDWLRPLQVLDLRGDWAVRRPLVRPGGWAFQYANAYYPDVDDTAVVAAAMDRFMRAHHAPGRYGEAVARATEWIVGMQSGNGGWGAFEPENTHLYLNNIPFADHGALLDPPTADVSARCLSMLCQTGATPANSEPAARALRYLLAEQMPDGSWFGRWGTNYIYGTWSALCALNAAGLPPEAPELCRAVAWLARIQNADGGWGEDGSSYRLDYSGYEPAPSVASQTAWALLALMAAGAAQHPAVARGIDYLLRTQQPGGLWHEPRFTAVGFPRVFYLRYHGYARYFPLWALARYRNLQRGLGDHGGNSGQVAWGL

SEQ ID NO: 118 - protein, 663 aa, Cyanothece sp.
MLTYKEYRRSVTEIAMQTRDRQTQKPALSLNDAITASQNYLLSLQYPQGYWWAELESNITLTAETVLLHKIWGTDKTRPLHKVEAYLRQQQREQGGWELFYGDGGEISTSVEAYMALRLLGVPQDDPALIRAKDFILSKGGISKTRIFTKFHLALIGCYSWKGIPSIPPWIMLFPNSFPFTIYEMASWARESTVPLIIVFNDKPVFAVDPIFNLDELYAEGIENVKYELPKNNNWGDIFLGLDKVFKFAEQVDLVPFRKKGLQAAERWMLNHQQETGDWGGIMPPMVNSLLAFRVLNYDVNDPSVQRGFEAIDRFSIEENETYRVQACVSPVWDTAWCVRALTNSGLPKDHFSLVKAGKWLLEKQCLEYGDWAVKNKTGKPGGWAFEFTNRFYPDIDDSAVVVMALNGIKLPDEARKQAAINRCVKWIETMQCKEGGWAAFDVDNDQAWLNEVPYGDLKAMIDPNTADVTARVVEMVGSCDLEISSKRLNKALNYLYKEQEKDGSWFGRWGVNYIYGTSGVLSALAVINPEKHQPQIEQGINWLLSCQNKDGGWGETCWSYNDSNLKGKGISTASQTAWALIGLLDAGEALNHFETDSIQRGISYLLNTQTEEGTWEESEFTGTGFPCHFYIRYHFYRHYFPLIALGRYQNLSSEFGIRNSEL

SEQ ID NO: 119 - protein, 643 aa, Cyanothece sp.
MQIQDRNSSPQVTEVLNQVKDAIAASQDYLMSIQYPEGYWWAELESNVTITAEVVLLHKIWGTDKTRPLHKVETYLRRQQREHGGWELFYGDGGDLSTSVEAYMALRLLGVSIDDPALIRGREFILKRGGISKSRIFTKLHLALIGCYDWRGIPSIPPWIMLLPENFPFTIYEMSSWARSSTVPLLIVFDKKPVYCCDPTINLDELYSEGIENVKYDLPKTGDWTDIFVWLDGVFKFAQDYNLVPLRQESLQAAERWVLERQEDSGDWGGIIPAMLNSLLALRALNYEAVDPIVHRGLQSVDNFAIETEDTYHVQPCISPVWDTAWAIRALVESGLKADDPRLVKGAQWLLDKQILDYGDWAVKNKQGTPGGWAFEFDNRWYPDLDDSAVVVMALDQVKMPNEDLKNGAIRRCVRWMATMQCKDGGWGAFDLDNDQNWLNFLPYADLKAMIDPNTSDVTARVLEMLGTCGLIMDSNRVQKAIAYLEKEQEPDGSWFGRWGVNYIYGTSGVLSALAVIAPETHQKELKKGAAWLVGCQNADGGWGETCFSYNDSSLKGKGDSTASQTAWGLIGLLAAGEATGEFFKTAIERGVNYLLKTQREDGTWDENYFTGTGFPCHFYLKYHLYLQYFPLIALSRYQRLLT

SEQ ID NO: 120 - protein, 651 aa, Cyanothece sp.
MQTQNRVTSTQKVELSNLTQAIIASQNYILSRQYPEGYWWGELESNITLTAETVLLHKIWKTDKTRPFHKVETYLRRQQNEQGGWELFYGDGGELSTSVEAYMALRLLGVTPEDPALIRAKDFILSKGGISKTRIFTKFHLALIGCYDWKGIPSIPPWIMLFPDNFPFTIYEMSSWARESTVPLLIVFDKKPIFEIEPAFNLDELYAEGVENVKYALPRNHNWSDIFLGLDKLFKWTEKNNLVPFHKKSLQAAEKWMLNHQQESGDWGGIMPPMVNSLIAFKVLNYDVADPSVQRGFEAIDRFSIEEEDTYRVQACVSPVWDTAWVIRALVDSGLKPDHPSLVKAGEWLLDKQILEYGDWAIKNKQGKPGGWAFEFINRFYPDLDDSAVVVMALNGIKLPDENRKKAAINRCLEWMATMQCKPGGWAAFDVDNDQAWINEIPYGDLKAMIDPNTADVTARVLEMVGSCGLKMDENRVQKALFYLEKEQESDGSWFGRWGVNYIYGTSGVLSALAVIAPNTHKPQMEKAVNWLISCQNEDGGWGETCWSYNDSSLKGTGISTASQTAWAIIGLLDAGEALETLATDAIKRGIDYLLATQTPDGTWEEAEFTGTGFPCHFYIRYHLYRHYFPLIALGRYWKIGLKTPSVIPLN

SEQ ID NO: 121 - protein, 647 aa, Cyanothece sp.
MQTQNRVTSTQKVELSNLTKAIIASQNYIMSRQYPEGYWWGELESNITLTAETILLHKIWKTDKTRPFHKVETYLRRQQNEQGGWELFYGDGGELSTSVEAYMALRLLGVTPEDPALIRAKDFILSQGGISKTRIFTKFHLALIGCYDWKGIPSIPPWIMLFPDNFPFTIYEMSSWARESTVPLLIVFDKKPIFEIEPAFNLDELYAEGVENVKYALPRNHNWSDIFLGLDKLFKWTEKNNLVPFHKKSLQAAERWMLNHQQESGDWGGIMPPMVNSLIAFKVLNYDVADPSVQRGFEAIDRFSIEEEDTYRVQACVSPVWDTAWVIRALVDSGLKPDHPSLVKAGEWLLDKQILEYGDWAIKNKQGKPGGWAFEFINRFYPDLDDSAVVVMALNGIKLPDENCKKAAINRCLEWMATMQCKPGGWAAFDVDNDQAWINEIPYGDLKAMIDPNTADVTARVLEMVGSCGLKMDENRVQKALFYLEKEQESDGSWFGRWGVNYIYGTSGVLSALAVIAPNTHKPQMEKAVNWLISCQNEDGGWGETCWSYNDPSLKGTGVSTASQTAWALIGLLDAGEALETLATDAIKRGINYLLDTQTPDGTWEEAEFTGTGFPCHFYIRYHLYRHYFPLIALGRYWKIGLKNLKG

SEQ ID NO: 122 - protein, 643 aa, Cyanothece sp.
MQIQARNISTKVTEVFSKVKEAIAASQQYLLSIQYPEGYWWAELESNVTITAEAVLLHKIWGTDTTRPLHKVETYLRRQQREHGGWELFYGDGGDLSTSVEAYMALRLLGVSASDPALVRAKAFILSRGGISKSRIFTKMHLALIGCYDWRGVPSIPPWIMLLPENFPFTIYEMSSWARGSTVPLLIVFDKKPVYQCGITLDELYSEGINHVRYDLPRNGDWTDVFVWLDGVFKFAETNNLIPFRNESLKAAERWVLERQEDTGDWGGIIPAMLNSLLALRALDYEVNDPIVHRGFKSVDNFAIETEETYHVQPCISPVWDTAWVLRALVESGLKPDEPVLVKGAQWLLDKQILDYGDWAVKNKEGTPGGWAFEFDNRWYPDLDDSAVVVMALEQVKMPDEQLKYGAMRRCVRWMATMQCKAGGWGAFDVNNDQNWLNYLPYADLKAMIDPNTADVTARVLEMLGTCELSMDHDRVKRAIAYLEQEQEADGSWFGRWGVNYIYGTSGALSALAAIAPVTHQAQIEKGAAWLVGCQNPDGGWGETCFSYNNPALRGKGDSTASQTAWGLIGLLAAGEATGKFAKTALERGVNYLLATQRPDGTWDESYFTGTGFPCHFYLKYHLYLQYFPLIALSRYQRLLGFN

SEQ ID NO: 123 - protein, 640 aa, Cyanothece sp.
MQTRDRQTHKPALSLNDAITASQNYLLSLQYPQGYWWAELESNITLTAETVLLHKIWGTDKTRPLHKVEAYLRQQQREHGGWELFYGDGGEISTSVEAYMALRLLGVPSNDPALIRAKNFIISQGGISKTRIFTKFHLALIGCYSWKGIPSIPPWIMLFPNSFPFTIYEMASWARESTVPLIIVFNDKPVFAIDPIFNLDELYAEGIENVKYELPKNNNWGDLFLGLDKVFKLAEQVDLVPFRKQGLQAAERWMLDHQQETGDWGGIMPPMVNSLLAFRVLNYDVADPSVQRGFEAIDRFSIEENDTYRVQACVSPVWDTAWCIRALTDSGLPKDHFSLVKAGKWLLEKQVLEYGDWAVKNKTGKPGGWAFEFTNRFYPDIDDSATVVMALNGIKLPDEALKQAAINRCLKWIETMQCKAGGWAAFDVDNDQAWLNEIPYGDLKAMIDPNTADVTARVVEMVGSCDLEMSSDRLNKALDYLYEEQEKDGSWFGRWGVNYIYGTSGVLSALAVINPKQHKSQIEQGMNWLLSCQNEDGGWGETCWSYNDLSLKGKGVSTPSQTAWALIGLLDAGEVLNHFETDSIERGINYLLNTQTEEGTWEESEFTGTGFPCHFYIRYHFYRHYFPLIALGRYQQMLGS

SEQ ID NO: 124 - protein, 668 aa, Cyanothece sp.
MQIRATVDTAKLEKAIAASQEHLLSTQYPEGYWWAELESNVTMTAEVVLLHKIWKTDGTRPMHKAEKYLRSEQREHGGWELFYGDGGDLSTSVETYTALRLLGVPASDPALLKAKDFILRRGGISKTRIFTKLHLALIGCYDWRGLPSLPPWVMLLPENFPFTIYELSSWARGSTVPLLIVMDRKPVFSVNPQINVDELYAEGRDRVKFELPRKGDWTDLFIELDGLFKFTEQNNLVPFREEGLRAAERWVLERQEATGDWGGIIPAMLNSLLALRALGYHPADPYVRRGMAAVDRFAIETADTYRVQPCVSPVWDTALVMRGLIDSGLPADHPAIVKAGEWLLEKQILAYGDWAVKNKTGQPGAWAFEFENRFYPDVDDSAVVVMALQAAQLPDEDLKQQAIERCVKWIATMQCKPGGWAAFDVDNDQDWLNQIPYGDLKAMIDPNTADVTARVLEMIGRSGVTTGEASVERALAYLRREQEVEGCWFGRWGVNYIYGTSGVLAALALIAPKSDHAMIQRGADWLVRCQNADGGWGETCRSYNDPHLKGQGPSTASQTAWALIGLLAAGEATGEFAWGAIDRGINYLLATQQQDGRWDEDWFTGTGFPGHFYLKYHLYQQHFPLTALGRYSSLTGLKQELKIPLQLKSKPEVVMIEDSDLLSDEDAT

SEQ ID NO: 125 - protein, 651 aa, Cyanothece sp. PCC 8802; identical to SEQ ID NO: 120

SEQ ID NO: 126 - protein, 705 aa, Desulfovibrio salexigens
MNKKSAMKLKKKAKNHVVSLLQPTDALNRVMKRFRSLQSPEGYWVFALEADVTIPSEYIMFNRFLGRKMDKGLAERLGNYIRAKQMADGGWPLHDNDGPVNISASVKAYMALKMLGDNKDAEHMVRARQIILAKGGAETANVFTRICLATFGQIPWHCPPAMPIEIVLLPKWFFFHLDKVSYWSRSVIYPLLIIYAKQPVCRLRPEEAVPELFCKPAEEHIHIDKYRDKGWRKNLFILLDRVLKRTIHLVPKSINKKALNYAEKWTREHMAGRGGIGAIFPAMANAVMALSLLGYDESDPDFARGMQSVDDLMVDKFHVPEKSPWEHTVITGGAELSAAPELDISPDHGTAENLEQAMCQPCNSPIWDTCLTLSAMMEAGENQDSKSTQQALNWLWDQQIFFRGDWISKAPKLEGGGWAFQFENTFYPDLDDTAMVLMAMCRAGVLDQPEHRENFIKGVNWLIGMQSSNGGWAAFDIDNCAEYLNDIPFADHGALLDPPTSDLTARVIELLGVLGYDKSFRPIKDGIEFLKKEQEDDGSWFGRWGVNYIYGTWSVLCGLRQAGEDMNSSYVCKAVEWFENHQNKDGGWGESCLSYNDKNYAGLGDSTASQTAWALLGLMAAGRVHSKAVSRGVRYLLDTQKDDGSWDESLFTGTGFPRVFYLRYHGYSQYFPMWALGVYQRFSADEDTKQIMMRRKSPLDLGRKW

SEQ ID NO: 127 - protein, 685 aa, Dryopteris crassirhizoma
  misc_feature (145)..(145): Xaa can be any naturally occurring amino acid
MLPYNQDFYNEDEALKDDHCEGAGNVSNPPTLDEAIKRSQDFLLSQQYPEGYWWAELEGNPTITSHTVILYKILGIEDEYPMDKMEKYLRRMQCIHGGWELFYGDGGQLSVTIESYVALRLLNVPPTDPALKKALKFIIDKGGVXKSRMFTKICLALLGCFDWRGIPSLPPWVMLLPGWFLSSIYETACWARGCVVPLIVVFDKKPVFKVSPEVSFDELYAEGREHACKTLPFCGDWTSHFFIAVDRVFKMMERLGVVPFQQWGIREAEKWLLERQEDTGDFLGVYPPMFYSVVCMKTLGYEVTDPVVRRALLSFKKFSIERADECSVQSSLSPVWDTALVVRSLVESGLPPDHPALQRAGEWLLQKQITKHGDWSFKNQSGVAGGWAFQFFNRWYPDLDDSAVVVMALDCLKLPNEDVKNGAITRCLKWISSMQCKGGGWAAFDKDNHQHWINSTPFSDLKAMVDPSTTDISARVLEMVGRLKLHGTSFDEAHFLPPESIARGLVYLRREQENEGCWFGRWGVNYIYGTCGALVALSLVAPMTHEEEIARGARWLVQVQNMHGKKINGPQDGGWGETCFSYNDPALKGQGDVSTASQTAWALQGLLAAGDALGKYEVESIGHGVQYLLSTQRKDGSWHESQFTGGGFPIHFYLRYHFYAQHFTLSSLARYRTRLQASKIKPPIP

SEQ ID NO: 128 - protein, 747 aa, Frankia alni
MPDLELRDVDRADGRHHAPNLGRTDTLSPSAPTGEPAPASTPAAVATPTPTPTTAPAPAPAPENALRETVQRAAEHLLRLQDPRGWWKFDLETNPTMDAEDLLLREYLGIRTVEQTEATAKHIRSRRLDDGSWPTYFGGPGELSTTVECYIALRLAGDSPDDEPLRRSAAWIRERGGIPATRVFTRIWLALFGWWRWEDLPVLPPEIMFLPPRAPLSIYSFASWARQTIVPLTIVSAARPQCPAPFDLAELDPDEVPAAQSHGAAQSPDTRSPAGGRTLRGAMRRLGGDRPNTAKVFFRGLDAALHRYHRHPIGPLRRHALRTAERWIIARQEADGCFGGIQPPAVYSIIALRLLGYDLDHPVLAAALRSLDAYTLHREDGSRMIEASQSPIWDTALAVLALADAGIDAPADVDVAPALPTQRVATGAPAPSAPVPTALERAADWLLGQEIQHRRGDWAITHPGVAPGGWAFEFDNDTYPDTDDTAEVVLALHRLNRLRRLRHPTNTRIDAALERSTAWLFALQSRDGGWGAYDSDNASTLVYQIPFADFGALTDPSSADVTAHVVELLCETGRIRDPRTLRGVDWLLRNQEADGSWYGRWGVNYVYGTGSVLPALQAAGLPPTHPAMVAGARWLLSRQNSDGGWGEDIRSYGDPAWSGRGLSTPSQTAWAMLGLLATDHGGVHADALAAAARWLTEQQRPDGGWDEEMFTGTGFPGFFYLNYHGYRLVWPVMALGRYLHSRQHPSD

SEQ ID NO: 129 - protein, 704 aa, Frankia alni
MSLTSDPSPAAPTAEKSPKRPTIPVPATADAYGISRSSPPLPAATGRPQAAGPASAGVATARARDHLLALQSEEGWWKGDLETNVTMDAEDLFMKQFLGIRGDDETEQTARWIRSQQLADGGWPTFYGGPADLSTTIEAYIALRLAGDAVDAPHMARAAELVRAQGGVAASRVFTRIWLAALGQWSWDDVPVIPPELIFLPSWIPLNVYDFACWARQTIVALTIVGSLRPSHDLGFSIDELKVPAAARKPAALRSWEGAFERLDKLLHRYEKRPIKLLRTLALRRATEWVVARQEADGCWGGIQPPWVYSVMALHLMGYPLNHPVIATAFRGMERYVIRRDTPQGPIRQIEACQSPVWDTALAVVALADAGVPGDHPAMVKAGRWLVDEEVRVAGDWAVRRPELAPGGWAFEFDNDFYPDVDDTAEVVLALRRLLGAGHVAPPASRQGRAEAPPVNTVEDADPRLAAAMRAAAARGVDWSVGMRSSNGAWGAFDADNVRTLTTKIPFCDFGEVVDPPSADVTAHIVEMLADLGRSDHPITQRAVQWLLDNQEPGGSWFGRWGVNHLYGTGAVVPALIGAGVPTDHPAITAAVRWLLEHQSPEGGWGEDLRSYTDPAWIGRGELTASQTAWALLALLAVDPHSLAVKRGVRWLCETQRPDGTWDEPYFTGTGFPGDFSLNYHLYRLVFPLTALGRYVSLTGVATP

SEQ ID NO: 130 - protein, 741 aa, Frankia sp.
MSLTSDPSPAAPKAAKSSKRVNIPAPATPDAYGISRSSPPLSGGGVSGGGVSGGGAATADGTPPTTQTSVDPDLAAAMTAANQARDHLLGLQSEEGWWKGDLETNVTIDAEHLFMKQFLGIRTEEETEPIARWVRSQQLADGGWATYYGGPAELSTTVEAYIALRLAGDEPDAPHMAAAAALIRSQGGVAAARVFTRIWLATFGEWSWDDVPVLPPELIFLPSWFPLNVYDFGCWARQTIVALTIVGSLRPVRDLGFSIDEIKVAAPVTPPKPAPLHSWEGAFERLDAILHRYERRPIKVLRTLALRRATEWVVARQEADGCWGGIQPPWIYSVMALHLMGYPLNHPVIATAFRGMERYIIRRETPEGPTAQIEACQSPVWDTALAVVALSDAGVPADHPAMVRAGRWLVDEEVRVAGDWAVRRPALAPGGWAFEFDNDFYPDTDDTAEVVLALRRLLGGSHVTPGGTVTPSGSVTPGGTAELSPAARDRASRGLAAVDPQLAGAMRAAAARGVDWSVGMRSSDGAWGAFDADNVRTLTAKIPFCDFGEVVDPPSADVTAHIVEMLADLGRSDHPITRRAVQWLLDNQEPGGSWFGRWGINHVYGTGAVVPALIAAGVPADHPAITAAVRWLLEHQSPDGGWGEDPRSYDDPAWIGRGELTASQTAWALLALLAVDPHSKAVKRGVRWLCETQRPDGTWDEPQFTGTGFPGDFYLNYHLYRLVFPLTALGRYVTLTGVATP

SEQ ID NO: 131 - protein, 728 aa, Frankia sp.
MSLTSDQSSAAPTAAAQSPKIPNPSVARPSADAGSFETAGAVRTDSVSIDSVSTGTPVDPVVGAMRRGRDHLLSLQAEEGWWKGELETNVTMDAEDLMLRQFLGILTPSTATETGRWIRSQQLSDGGWATFYGGPSDLSTTIEAYVALRLAGDDPDAPHMRSAAEWVRSAGGIAASRVFTRIWLALFGEWSWDDVPVLPAEMTFLPPWFPLNIYDFACWARQTVVALTIVGSLRPVRSFGFTLDELRVQAPKATKAPLRSWAGAFERLDSVLHRYEKRPFQPLRRLALRRAAEWVIARQEADGCWGGIQPPMVYSIMALHLMGYPLNHPVISMAFRALDRFTIREETPEGTVRRIEACQSPVWDTALAVVALADAGLGGDHPAMVRAGRWLADEEVRVAGDWAVRRPTLAPGGWAFEFDNDFYPDVDDTAEVVIAIRRLLGDGHGPVDHSDGSGPGSAAATAASAAAEAAVAAAGTIAAADPELAARLRAAAERGVDWSVGMRSSNGAWAAFDADNVRTLVRKIPFCDFGEVVDPPSADVTAHMVEMLALLGRSDHPITQRGVRWLLDNQEAGGSWFGRWGVNHVYGTGAVVPALISAGVDAEHPAIVSSMHWLVEHQTPEGGWGEDLRSYRDDEWIGRGEPTASQTAWALLALLAAEPASGTAEWEAVERGVRWLCDTQRPDGTWDEPQFTGTGFPWDFSINYHLYRLVFPVTALGRYVTLTGRSTS

SEQ ID NO: 132 - protein, 689 aa, Frankia sp.
MFQGSDRPPVTLVMNDMRGPDMNVSDTVSVTRESIPTQTSAGDATARDLTAAVGSELTRALRLATDHLLALQDGTGWWKFDLETNTSMDAEDLLLREYLGIRTTEVTAASARFIRSRQSDDGSWPQYFGGPGELSTTVESYIALRLAGDDASAPHMLSAATWVRDHGGVPATRVFTRIWLALFGWWRWEDLPALPPEIMLLPRRAPLNIYSFGSWARQTLVSLTVVSALRPVRPAPFDLDELYPDGPASAWSGAGPSNVLERISTRFTAKEIFLGIDRLLHVYHRRPVRSMRNHALRAAERWIIARQEADGCFGGIQPPAVYSIIALRLLGYELDHPVLKAALRALDDYSVTLPDGSRMVEASQSPVWDTALAVNALADAGATAAIAPDHPALVRAAGWLLGQEVRHRRGDWAVNHPDVPASGWAFEFENDTYPDTDDTAEVLLALRRVRHPARDELDAAERRAVAWLFGLQSSDGGWGAYDADNTSTIPYQIPFADFGALTDPPSADVTAHVVELLAEAGLGGDDRTRRGVDWLLDHQEADGSWFGRWGVNYVYGTGSVMPALRAAGLEPSHPAMRAGADWLLTHQNADGGWGEDLRSYTDPEWSGRGESTASQTAWAMLALLTVGDQPEVSGALARGARWLADHQRPDGSWDEDQFTGTGFPGDFYINYHGYRLLWPIMALGRYLRG

SEQ ID NO: 133 - protein, 773 aa, Frankia sp. EuI1c
MTTTDETALAAGTPKAAFAPAPRGAADDLVARTVAVEAPPSPAPASDDTLARAVAHLKSLQDEAGWWKGDLETNTTMDSEDLMLRHWLGIWNPEQAERTARFIRSKQYADGSWPIYHAGPGDLNATVESYVALRMVGDSPQDPHMRAAAAWARARGGVPATRIFTRIWLALFGWWRWEDLPVLPPELIFVPAKMPLSIYKFASWGRQTIVAIMVLMAHRPAGTPPFPIAELFPPPATKKKAAAQRKAQKKAGHAGGPTAWRDSSIDDMFTEPAPGTDTLRQPAALAIGPARPAPAKGRRGKGQPAAPDVMGRAKDGGGPGLPLPARLVSRVGFRTRRALRQAALDHVNWNLLFGGIDRFLHVYHRHPIRPVRSLALGLAERWIVVRQEADGCFGGIQPPTVYSIMALRVLGYPMDHPVMTAALRSLDEYSVTLPDGARMQEACQSPVWDTCLATIALADAGVPRDDPSLVRAADWMLAEEVRERRGDWSVPIPDVPTGGWSFEFDNDTYPDVDDSAEVMLALMRVAHPRPEKVVAATYRGLQWVFGMQCADGGWGAFDVDNAGELVYKIPFADFGMLTDPPSADVTAHVVELLGELGLGDDPRTKRGVEWLLHSQEADGSWYGRWGVNHLYGTGGVVPALRAAGLPASHPAIQRAADWLVAKQNPDGGWGESCYSYDEMSTAGVGVSTASQTAWALLALIAAGRVGDGVTGEAAARGVAWLAETQTAEGTWDEDYFTGTGFAGYFYINYHLYRLVWPVMALGRYQAALAGKGH

SEQ ID NO: 134 - protein, 764 aa, Frankia sp. EuI1c
MSLTSDPSPATPATQPTSARPGSLSDRRSRSGGSAVAGPVLVTTRPVAPVAKSGAVTPTATSGAVTSTATSGPALLPDLATDLADPTGPLAGAASATVRAAGGAGTRTQQTGQLGSTELAGPQADQVADRAAAVLGRARDHLLGLQSEAGWWKGELETNVTMDAEDLMLRQFLGILPPELAAETGRWIRSKQQDDGGWPTFHGGPSDLSTTFEAYVGLRLAGDLPDAPHMLAAASFVRAHGGLAATRVFTRIWMALFGEWPWDEVPVLPPELVLLPSWVPLNVYDFGCWARQTVVALTIVGHFRPVRSLGFSIDELRVAAVRPDRAPLVSWTGVFQRLDAGLRRYQRHPVKTLRELALRRATEWVLARQEADGGWGGIQPPWVYSIMALHLMGYSMDHPVLVAALDGLETFTVREQVREGDEVVTVRRLEACQSPVWDTALAVVALADAGLDARHPAMRKAGEWLVREEVTVPGDWRVRRPNLEPGGWAFEFANDIYPDVDDTAEVVLAVRRLLGSGWDDVDPTFAKQARASVERAVNWSVGMRSANGAWGAFDADNVRELATKIPFCDFGEVIDPPSADVTAHMVEMLADLGRADHPVTQRAVRWLLDDQEPGGSWFGRWGVNHVYGTGAVVPALISAGVAADHPAIRSAVRWLVAHQHPDGGWGEDLRSYQDDAWVGRGEPTASQTAWALLALLAADPMNEAVGRGVRWLCDTQLPNGTWDEPYYTGTGFPWDFSINYHLYRLVFPLTALGRYVTLTGRSAA

SEQ ID NO: 135 - protein, 612 aa, Gemmata obscuriglobus
MIPAERLRTAYRTARAALLAERVPEGHWVGELSTSALSTATAVMALHLVNPFTHRELIDAGRKWLAEHQNADGGWGDTVKSFSNISTTMLCRAAFKLAGEKEYPETVQRVEEYLSRNAGALPTARAAAIRARYGKDHTFSVPILMTCAVAKLVPWDEVPRLPFELACLPQSWYRFAKLPVVSYALPALIAIGQCIHHHRRSQNPIRNTVRRLARGLSLKVLRRIQPTSGGYLEATPLTSFVVMALSSIRRRRAAAEQQVIDEGVRFLVASVRPDGSWPIDTNLATWVTTLSVNALATAGDLEALDTKEQILAWLLKQQYKERHPYTGADPGGWAWTDLPGGVPDCDDTPGALIALAHLDPKSDPQAVLSGLRWVLRLQNGDGGAPTFCRGWGTLPFDRSGADLTAHSVRSLASWYRVWGAGPPPIEHLRHRLKDLEFPLSGLFWDVARRNPRFVRYLKKQQRSDGSWLPLWFGNQHAPDDINPVYGTARVLAAYRDLELKDAPECRRGIEFLLSVQNADGGWGGAKGCPSSVEETALAVEVLLDLADGDAVQKGVAWLAEAVESDRFRDASPIGFYFAKLWYFEKLYPIIFTVAALGRAVKITSPAPAAESA

SEQ ID NO: 136 - protein, 618 aa, Geobacillus sp.
MVADERSALIDALKRSQSVDGSWRFPFETGISTDAYMIILLRTLGIHDEPLIQALVERIESRQDANGAWKLFADEGDGNVTATVEAYYALLYSGYRKKTDSHMQKAKARILEVGGLERVHLFTKVMLALTGQHSWPRRFPLPLVFFLLPPSFPLNMYDLSVYGRANMVPLLVVAERRYSRKTDNSPDLSDLAASRNDWRLPDTEALWSYVKRSLTGLPAWLHRAAEQRAVRYMLEHIEPDGTLYSYFSSTFLLIFALLALGYPKDDPHIARAVRGLRSLRTEIDGHTHMQYTTASVWNTALASYALQEAGVPPTDRTIEKANRYLLSRQHIRYGDWAVHNPYGVPGGWGFSDVNTMNPDVDDTTAALRAIRRAAAKETAFRHAWDRANRWLFSMQNDDGGFAAFEKNVGKRFWRYLPIEGAEFLLMDPSTADLTGRTLEYFGTFAGLTKDHSAIARAIDWLLDHQEADGSWYGRWGICYVYGTWAAVTGLSAVGVPIDHPAMQKAVRWLLSIQNDDGGWGESCKSDGAKTYVPLGASTPVHTAWALDALIAAAERPTPEMKAGVRALVRMLHHPDWTASYPVGQGMAGAFYIHYHGYRYIFPLLALAHYEQKFGPFVD

SEQ ID NO: 137 - protein, 617 aa, Geobacillus sp.
MAGERSALITALKRSQAADGSWRFPFETGISTDAYMIILLRTLDINDEPLIQALVERIESRQEANGAWKLFADEGDGNVTATVEAYYALLYSGYRQPTDRHMQKAKRRILDMGGLDRVHLFTKVMLALTGQYPWPGRFPLPLEFFLLPPSFPLNMYDLSVYGRANMIPLLIAADSRYSRKTDKSPDLSDLFASRGDWGMPESRSLLTYVKRSLIGLPAQLHQAAKQRAVRYLFEHIEPDGTLYSYFSSTFLFIFALLALGYRNDDPRIRQAVRGLRSLRTTIDGHVHLQYTTASVWNTALASYTLQEAGVPMTDRAIEKANRYLLSRQNVRYGDWAVHNPYSTPGGWGFSDVNTMNPDVDDTTAALRAIRQAAAKETAFRHAWDRANQWLFSMQNDDGGFAAFEKNVSSRFWRYLPIEGAEFLLMDPSTADLTGRTLEYFGTFAGLTKDQRAVSRAVDWLLSHQERNGSWYGRWGICYIYGTWAAITGLTAVGVPAHHPALQKAVRWLLSIQNDDGGWGESCKSDGAKTYVPLGDSTPVHTAWALDALVAAAERPTLEMKAGFRALFRLLHHPDWTASYPVGQGMAGAFYIHYHSYRYIFPLLALAHYEQKFGPLDD

SEQ ID NO: 138 - protein, 618 aa, Geobacillus sp. Y412MC52; identical to SEQ ID NO: 136

SEQ ID NO: 139 - protein, 618 aa, Geobacillus sp. Y412MC61; identical to SEQ ID NO: 136

SEQ ID NO: 140 - protein, 617 aa, Geobacillus thermodenitrificans; identical to SEQ ID NO: 137

SEQ ID NO: 141 - protein, 680 aa, Geobacter bemidjiensis
MTSPFKHPISNALTSFNGNVAEPEQSVEQQSGAKVHHLPASIWKRKMGRAKSPLDVAIEGSRDFFFQEQLPKGYWWAELESNVTITAEYIMLFHFLGLVDPERQRKMSTYLLSKQTEEGFWTIYYGGPGDLSTTIEAYFALKLSGYPEDHPALAKARAFILEQGGVVKSRVFTKIFLALFGEFDWQGIPSMPVELNLLPDWAYINIYEFSSWARATIVPLSVVMHSRPVRRVPPSARVQELFVRQPTAADYSFAKNDGLFTWEKFFLGLDRVLKVYEKSPLRPFKKTALAKAEEWVLEHQEPTGDWGGIQPAMLNAILALNVLGYRNDHPAVEQGLRALANFCIETEDQLVLQSCVSPVWDTALALKALLDAGVPPDHPSLVKGAQWLLDKEVTRAGDWRVKSPNLEAGGWAFEFLNDWYPDVDDSGFVMIALKGIQVKDHKAMDAAIKRGINWCLGMQSKNGGWGAFDKDNTKHVLNKIPFADLEALIDPPTADLTGRMLELMGTFDYPVTFPAAQRAIEFLKKNQEPEGPWWGRWGVNYLYGTWSVLCGLAAIGEDMDQPYIRKAVNWIKSRQNIDGGWGETCQSYHDRTLAGVGESTPSQTGWALLSLLAAGEMHSATVVRGVQYLISTQNSDGTWDEQQYTGTGFPKYFMIKYHIYRNCFPLMALGTYRTLTRTQP

SEQ ID NO: 142 - protein, 684 aa, Geobacter lovleyi
MKSRKYPISHALTSFNHTTVAPVEAPAPISVKSPAKVHRLPSSIWKKMEGSAGNPLDKAVELTRDFFFREQLPDGYWWAELESNVTITAEYIMLFHFLGMVDKDKERKMANYLLRQQTEEGYWTVWHNGPGDLSTTIEAYFALKLAGYHADHIALRKARDFILANGGILKSRVFTKTFLAMFGEFSWLGVPSMPIELMLLPDWAYLNVYEFSSWARATIIPMSVLMANRPVYKLPPHARVQELYVRPPRPTDYTFTKEDGIFSLKNFFIGVDHLLKIYESSPIRPFKKRATEKVEQWILEHQEKTGDWGGIQPAMLNAILALHCLGYANDHPAVAKGLEALANFTIEDSDSLVLQSCISPVWDTALVLQAMQEASVPLDHPSLIKASQWLLDREVRIKGDWKIKSPDLEPGGWAFEFQNDWYPDVDDSTAVMIAIKDIKVKNTKARQDAIRRGIDWCLGMQSENGGWAAFDKDNTKHMLNKIPFADLEALIDPPTADLTGRMLELMGNFGYTKDHPQAVSALEFLKNEQEPEGPWFGRWGVNYIYGTWYVLIGLEAIGEDMNSPYIKKSVNWIKSRQNLDGGWGEVCDSYWDRTLMGCGPSTASQTSWALMALMAAGEVGCQAVERGIQYLLATQNSDGTWDEEAFTGTGFPKYFMIKYHIYRNCFPLTALGRYRRLTAGTHAQ

SEQ ID NO: 143 - protein, 730 aa, Geobacter metallireducens
MAKGILNKFAVIAGNKNAGLTAEEECTVVAPIKEVSGKAVHCRQAVKMAEEYLLALQNPEGYWVFELEADVTIPSEYIMLQRFLGREISPELRMRLENYLLDRQLPDGGWPLYAVDGFANISATVKAYLALKVLGHSPQAPHMIRARIMVLSLGGAARCNVFTRILLALFGQLPWHTPPAMPVEIVLLPQRFFFHLSKVSYWSRTVIVPMLLLYAKQPVCRLRPEEGIPELFNTPPDKLRNLDGFQSGRWRKNAFIIIDRLLKRFNRFIPSAIHRKAMAEAEHWTRSRMQGSGGIGAIFPAMAYAVMALRVLGCREDDPDYVRGMQAIDDLLQHRTPQEADSPRTGGPCIDSGTSAAFAFDPSPHAAADGRGNSSICQPCNSPIWDTCLSLSALMEAGMPASHPAAKQAVEWLLSQQIFSPGDWSLKAPDLEGGGWAFQFENTLYPDLDDTSKVIMSLLRAGALENGLYRDRVARGVNWVLGMQSSDGGWAAFDIDNNYHYLNDIPFADHGALLDPSTSDLTGRCIELLSMVGFDRTFPPIAQGIGFLRSKQEGSGAWFGRWGVNYIYGTWSVLSGLRQAGEDMQQPYIRRAVGWLTSCQNHDGGWGETCYSYDDPSLAGQGESTPSQTAWSLLGLMAAGDVHSLAVRRGVRYLLDHQNQWGTWEEKHFTGTGFPRVFYLRYHGYRHYFPLWALGVYSRLSSGQKTRQEERRHSSPGDLHLPWLERIGRR

SEQ ID NO: 144 - protein, 679 aa, Geobacter metallireducens
MKISKHPISHALTSFNETAKETKEEPQKKRGGKVHHLPASIWKKRDVETTSPLDQAIKRSQEFFLREQLPAGYWWAELESNVTITAEYVILFHFMGLVNRDKDRKMATYLLSKQTEEGCWCIWHGGPGDLSTTIEAYFALKLAGYPADHPAMQKARTFILGKGGILKARVFTKIFLALFGEFSWLGVPSMPIEMMLLPNGFTFNLYEFSSWSRATIIPLSIVMAERPVRKLPPWARVQELYVRPPRPMDYTFTKEDGILTWKNIFIGIDHILKVYEASPIRPGMKKAMAIAEQWVLDHQEPTGDWGGIQPAMLNSVLALHCLGYANDHPAVAKGLQALANFCIESDDEIVLQSCISPVWDTALALMAMVDSEVPTDHPALVKAAQWLLDREVRKVGDWKIKAPNLEPGGWAFEFQNDWYPDVDDSGIVMMAIKDVKVKDSKAKAEAIQRGIAWCIGMQSKNGGWGAFDKDNTKHILNKIPFADLEALIDPPTADLTGRMLELMGTFGYPKDHPAAVRALQFVKENQEPDGPWWGRWGVNYIYGTWSVLCGLKAYGEDMGQPYVRKAVEWLAAHQNPDGGWGECCESYCDQKLAGTGPSTASQTGWALLSMLAAGDVDHPAVARGIRYLIETQQPDGTWDEDQFTGTGFPKYFMIKYHIYRNCFPLMAMGRYRALKGHKG

SEQ ID NO: 145 - protein, 714 aa, Geobacter sp.
MNKHKGTFSVIEGGKTTQARGSETCAIMDAADLEKVTSVAASQLAGQQQDDGHWVFDLEADVTIPAEYVMLQRFIGREIDPEISERLAAYMQERQLPDGGWPLYAVDGNVNISASVKAYFALKLLGHDKNAPHMVRARQLILSLGGAAKCNVFTRITLATFGQIPWHTAPAMPIEIMLLPRWFFFHLNKVAYWSRTVIVPLLILYATQPICRLQYNEGITELFTTPPDMLVHLDKFRHHAWRKNVFIALDRVLKRTMHLVPGRIKQHALAEAERWTRARMQGDGGIGAIYPAMANAVMALKTLGCSDDDADYLRGLEAVDNLMVHRNLKTGTIPMDDDSGGIAIDNSSAAPELSPTYLTDTAGNTEFSFCQPCNSPIWDTCMSLSALCESGYAENNSGVTDRAIKWLFSQQIATPGDWSEKCPGLESGGWAFQYENSRYPDVDDTAKVLMSLFRAGALEKPEYREKIERAIRWVQGMQSTDGGWGAFDVDNDYFYLNDIPFADHGALLDPSTADLTGRCIEMMGMLGHGPDYPPIARGIAYLKKEQEPFGGWFGRWGVNYIYGTWSVLSGLHQAGENMDAPYVRKAVEWLISCQNSDGGWGETCASYDDPSLAGSGASTASQTSWALMALMAAGEWRHSAVRNGVRYLTESYCNGWNEKQFTGTGFPRVFYLRYHGYSLFFPVWALAVYSRYINGTATVQEKVREKQFRQCLMV

SEQ ID NO: 146 - protein, 680 aa, Geobacter sp.
MTSPFKHPISNALTSFNGNFAEPEQCVEQQTGAKVHHLPASIWKRKMGKAKSPLDVAIEGSRDFFFQEQLPKGYWWAELESNVTITAEYIMLFHFLGLVDRERQRKMSNYLLSKQTEEGFWPIYYGGPGDLSTTIEAYFALKLSGYPADHPALAKARAFILEQGGVVKSRVFTKIFLALFGEFEWQGVPSMPVELNLLPDWAYINIYEFSSWARATIVPLSVVMHSRPVRRVPPSARVQELFVRQPTAADYSFAKNDGIFTWENFFLGLDRVLKVYEKSPLRPFKNMALAKAEEWVLEHQEPTGDWGGIQPAMLNAVLALNVLGYQNDHPAVEQGLRALANFCIETEDQLVLQSCVSPVWDTALALKALLDAGVPPDHPSLVKGAQWLLDKEVTRPGDWRVKSPALEPGGWAFEFLNDWYPDVDDSGFVMIALKGIQVKDRKSMDAAIKRGINWCLGMQSKNGGWGAFDKDNTRHVLNKIPFADLEALIDPPTADLTGRMLELMGTFNYPITLPAAQRAIEFLKKNQEPEGPWWGRWGVNYLYGTWSVLCGLAAIGEDMDQPYIRKAVNWIKSRQNIDGGWGETCQSYHDRTLAGVGESTPSQTGWALLGLLAAGEMHSATVVRGVQYLISTQNSDGTWDEQQYTGTGFPKYFMIKYHIYRNCFPLMALGTYRTLTRTQP

SEQ ID NO: 147 - protein, 688 aa, Geobacter sp.
MSPCKHPISHALTSFNGETADSVPVQTPKTGAKIHHLPPSIWKKKEGELKSPLDIAIENSRDFFFREQLPDGYWWAELESNCTITAEYVMLYHFMDLVDRERERKMANYLLSKQTEEGFWTIYYGGPGDLSTTVEAYFALKLAGYPADHPAMVKARAFILDNGGIIKTRVFTKIFLALFGEFAWFGVPSMPIELILLPNWAYFNMYELSSWSRATIIPLSIVMTQRPVRKLPPASRVQELYVRPPSPIDYTFTKEDGIFTWKNFFIGVDHILKVYESNPIRPFKKKAMLAAENWVLEHQEATGDWGGIQPAMLNSVLALHCLGYANNHPAVAKGLEALENFCIESEDSLVLQSCISPVWDTALALKALVDSDVPNDHPALVKAAQWLLDKEIRKAGDWKVKSPELEPGGWAFEFLNDWYPDVDDSGFVMMALKDVAVKDRKSMDTAIKRGISWCLGMQSKNGGWGAFDKDNTKYLLNKIPFADLEALIDPPTVDLTGRMMELMGTFGYAKDYPPAVRALDFIKRNQEPDGSWWGRWGVNYIYGTWSVLCGLSAMGEDLNQPYIRKAINWLKSRQNIDGGWGETCESYHDSSLAGIGASTASQTGWALLALMAVGEENASAVARGVQYLLATQKSDGTWDEDLYTGTGFPKFFMIKYHIYRNCFPLTALGTYRRKTGGRAEMQVSEHNK

SEQ ID NO: 148 - protein, 680 aa, Geobacter sp. M18
MTSPFKHPISHALTSFNGIVTEPEQSVEQKAGAKVHQFPASLWKSKPGKAKSPLDIAIEGCRDFFFREQLPKGYWWAELESNVTITAEYIMLFNFLSLVDHERQRKMSNYLLSKQTEEGFWTIYYGGPGDLSTTVEAYFALKLTGYPADHPAMVKARAFILEKGGVIKSRVFTKIFLALFGEFDWLGVPSMPVELNLLPNWAYVNVYEFSSWARATIIPLSIVMLKRPVHKLPPSQRVQELFVRPPRAIDYTFTKEDGIFTWKNFFIGLDHMLKVYERSPVRPFKKRAMGKAEEWVLEHQEETGDWGGIQPAMLNAVLALSALGYDNGHPAVAHGLKALENFCIESDEQIVLQSCISPVWDTALALKALVDAGVPSDHPSLVKGAQWLLEREVRRPGDWRVKSPDLEPGGWAFEFLNDWYPDVDDSGFVMIALKGVEVKDRKAMNAAVKRGIDWCLGMQSKNGGWGAFDKDNTRHILNKIPFADLEALIDPPTADLTGRMLELMGTFGYAKTYPAAQRALKFLKENQEPEGPWWGRWGVNYLYGTWSVLCGLAAIGEDLEQPYIKKAVNWIKSRQNMDGGWGETCESYHDPTLAGMGESTASQTGWALLGLMAAGEVHSATVVRGVQYLISTQSQDGTWDETQYTGTGFPKYFMIKYHIYRNCFPLMALGTYRTLTGGTA

SEQ ID NO: 149 - protein, 680 aa, Geobacter sp. M21; identical to SEQ ID NO: 146

SEQ ID NO: 150 - protein, 730 aa, Geobacter sulfurreducens
MAKGILNKFAVIAGTKKAGPPAGEERTVIAPIKEISGKAVHCSQAVKKAEEYLLALQNPEGYWVFELEADVTIPSEYIMLQRFLGREISPELGKRLENYLLDRQLPDGGWPLYAEDGFANISATVKAYLALKVLGHSPQAPHMIRARLMVLSLGGAARCNVFTRILLALFGQIPWHTPPAMPVEIVLLPQWFFFHLSKVSYWSRTVIVPLLLLYAKQPVCRLRPEEGIPELFSTPPDKLRHLDGFQPGYWRKNAFIIFDRLLKRFNRFIPSALHRKAIAEAEQWTRSHMQGSGGIGAIFPAMAYAVMALRVLGCGEGDPDYIRGLQAIDDLLQHRTPQEADPPRTDGTCIDSGMSAAFALTPSAHAAADGTGSSSICQPCNSPIWDTCLSLSALMEAGMPASHPAATQAVEWLLSQQILSPGDWSLKVPDLEGGGWAFQFENTLYPDLDDTSKVIMSLLRAGALENERYRDRIARGVNWVLGMQSSDGGWAAFDIDNNYHYLNDIPFADHGALLDPSTSDLTGRCIELLSMVGFDRTFPPIARGIGFLRSEQEENGAWFGRWGVNYIYGTWSVLSGLRQAGEDMQQPYIRKAVGWLASCQNHDGGWGETCYSYDDPSLAGKGASTPSQTAWSLLGLMAAGEVNSLAVRRGVRYLLDHQNQWGTWEEKHFTGTGFPRVFYLRYHGYRHFFPLWALGVYSRLSSGQKACQDERRHASPGDLHLPWLERIKKR

SEQ ID NO: 151 - protein, 679 aa, Geobacter sulfurreducens
MKISKNPISHALTSFNDAARETADNSAARKSGKIHHLPATIWKKKESTVSSPLDIAIERTQEFFFREQLPAGYWWAELESNATITAEYIMLFHFMGLVNREKERKMANYLLRQQTTEGYWTIWHGGPGDLSTTIEAYFALKLAGYPADHPSMSKARAFILEHGGILKARVFTKIFLALFGEFSWLGVPSMPIEMMLLPAGFTFNMYEFSSWSRATIIPLSIVMAERPVRKLPPWARVQELYVRPPRPTDYTFTKEDGILTWKNIFIGIDHVLKVYEASPIRPGRKKAMAIAEKWVLEHQEPTGDWGGIQPAMLNSVLALHVLGYANDHPAVAKGLQALANFCIEGEDELVLQSCVSPVWDTALGLMAMVDSGVPTDHPSLSKAAQWLLDREVRRPGDWKIKCPDLEPGGWAFEFMNDWYPDVDDSGIVMMAIKNVKVKDQRAKEDTITRGIAWCLGMQSKNGGWGAFDKDNTKHILNKIPFADLEALIDPPTADLTGRMLELMGTYGYPKDHPAAVRALKFIRETQEPDGPWWGRWGVNYIYGTWSVMSGLAAFGEDMSQPWIRKAVDWLVEHQNEDGGWGECCESYADPRLAGVGPSTASQTGWALLTLLAAGEVASSSVVRGVQYLLDTQKPDGTWDEDAFTGTGFPKFFMIKYHIYRNCFPLMALGRYRTLAGKGL

SEQ ID NO: 152 - protein, 679 aa, Geobacter uraniireducens
MNSCKHPISHALTSFNGETADAAKKQPVKPGAKIHHLPASIWKKKEGESKSPLDIAIENSRDFFFREQLPDGYWWAELESNCTITAEYLMLYHFMGIVDQERERKMATYLLSKQTAEGFWTIYFGGPGDLSTTVEAYFALKLAGYPADHPAMAKARAFILDNGGIIKCRVFTKIFLALFGEFAWFGVPSMPIELILLPNWAYFNMYELSSWSRATIIPLSIVMTERPVRKLPPSSRVQELYVRPPRPIDYTFSKEDGIITWKNFFIGVDHILKVYESNPIRPFKKRALATAENWVLDHQESTGDWGGIQPAMLNSVLALHCLGYANDHPAVAKGLEALANFCIETEDSLVLQSCISPIWDTALALKALVDSDVPTDHPALVKAAQWLLDKEVRKPGDWKIKCPELESGGWAFEFLNDWYPDVDDSGFVMMALKDVAVKDRKSMDGAIKRGINWCLGMQSKNGGWGAFDKDNTKYLLNKIPFADLEALIDPPTADLTGRMLELMGTFGYSKDYPAAVRALEFIKKNQEPEGSWWGRWGVNYIYGTWSVLGGLAAIGEDLNQPYIRKAVNWLKSRQNMDGGWGETCESYHDTSLAGIGESTPSQTGWALLSLMSAGEANSSTVARGIQYLIANQKSDGTWDEEQYTGTGFPKFFMIKYHIYRNCFPLTALGTYRKLTGGMA

SEQ ID NO: 153 - protein, 637 aa, Gloeobacter violaceus
MQVQPRIEKKHLDSAIEASQAYLLARQYSPGYWWAELESNVSMTAEVVLLHKIWRTDTGRPLAKATAHLLAEQRAHGGWELFYGDGGDLNTSIEAYMALKLLGLTADHPALARARAFILAKGGISRARIFTKIHLALIGCYDWRGVPSIPPWVMLLPEAFPVNIYEMSSWARGSTVPLLIVFDRKPVFAVEPAITLDELFVEGRAQARFDLPRSSSDWWANLFVDLDWGFKLAESLGAVPLREEGLKAAERWVLERQEATGDWGGIIPAMLNSLLALRCLDYDPHDPVVERGMAAVDRFAIETESTYRLQPCVSPVWDTALTMRALVDSGLPPDHPALAAAGTWLLKKQILDYGDWAVKNRTGPPGGWAFEFDNRFYPDVDDTAVVVMALDAVRLADETAKGQAIARAVCWVASMQCRGGGWAAFDIDNDAHWLNSLPYADLKAMIDPNTADVTARVLEMYGRCRLIPAAAGAQRALDYLRRTQEPEGCWFGRWGVNYLYGTSGVLSALAAFAPAERTAIERAAAWLRGCQNTDGGWGETCGSYVDRTLMGQGPSTASQTAWALLGLIDASRVARFSDSSALERGLAYLVETQKADGSWDEPYFTGTGFPGHFYLKYHLYQQHFPLSALGRYRRLLS

SEQ ID NO: 154 - protein, 663 aa, Gluconacetobacter diazotrophicus
MMANATDTIELPPSRAADRIVPMTDIDQAVDAAHAALGRRQQDDGHWVFELEADATIPAEYVLLEHYLDRIDPALEERIGVYLRRIQGDHGGWPLYHGGKFDVSATVKAYFALKAIGDDIDAPHMARARAAILDHGGAERSNVFTRFQLALFGEVPWHATPVMPVELMLLPRKALFSVWNMSYWSRTVIAPLLVLAALRPRAINPRDVHVPELFVTPPDQVRDWIRGPYRSQLGRLFKYVDIALRPAERLIPDATRQRAIKAAVDFIEPRLNGEDGLGAIYPAMANTVMMYRALGVPDSDPRAATAWEAVRRLLVELDGEAYCQPCVSPIWDTGLAGHAMIEAASGPEGIRPEDTKKKLAAAAEWLRERQILNVKGDWAINCPDVPPGGWAFQYNNDYYPDVDDTAVVGMLLHREGDPANDEALERARQWIIGMQSSNGGWGAFDIDNNLDFLNHIPFADHGALLDPPTADVTARCISFLAQLGHPEDRPVIERGIAYLRTDQEREGCWFGRWGTNYIYGTWSVLCAYNAAGVAHDDPSVVRAVDWLRSVQREDGGWGEDCASYEGATPGIYTESLPSQTAWAVLGLMAVGLRDDPAVMRGMAYLTRTQKDDGEWDEEPYNAVGFPKVFYLRYHGYRQFFPLLALSRYRNLASSNSRHVAFGF

SEQ ID NO: 155 - protein, 663 aa, Gluconacetobacter diazotrophicus
MMANATDTIELPPSRAADRIVPMTDIDQAVDAAHAALGRRQQDDGHWVFELEADATIPAEYVLLEHYLDRIDPALEERIGVYLRRIQGDHGGWPLYHGGKFDVSATVKAYFALKAIGDDIDAPHMARARAAILDHGGAERSNVFTRFQLALFGEVPWHATPVMPVELMLLPRKALFSVWNMSYWSRTVIAPLLVLAALRPRAINPRDVHVPELFVTPPDQVRDWIRGPYRSQLGRLFKYVDIALRPAERLIPDATRQRAIKAAVDFIEPRLNGEDGLGAIYPAMANTVMMYRALGVPDSDPRAATAWEAVRRLLVELDGEAYCQPCVSPIWDTGLAGHAMIEAASGPKGIRPEDTKKKLAAAAEWLRERQILNGEGRLGDQLPRRAPRRLGLPVQQRLLPRRGRHGSGRHVLHREGDPANDEALERARQWIIGMQSSNGGWGAFDIDNNLDFLNHIPFADHGALLDPPTADVTARCISFLAQLGHPEDRPVIERGIAYLRTDQEREGCWFGRWGTNYIYGTWSVLCAYNAAGVAHDDPSVVRAVDWLRSVQREDGGWGEDCASYEGATPGIYTESLPSQTAWAVLGLMAVGLRDDPAVMRGMAYLTRTQKDDGEWDEEPYNAVGFPKVFYLRYHGYRQFFPLLALSRYRNLASSNSRHVAFGF

SEQ ID NO: 156 - protein, 664 aa, Gluconobacter oxydans
MLIYSDILEKEDRVSETLSRQSVEPDEINHAIEGAQAALGGKQKSDGHWVYELEADATIPAEYVLLEHYLDRIDPEKQAKIGVYLRRIQGHHGGWPLYHDGGFDLSATVKAYFALKAIGDDINAPHMRIAREAILDHGGAARTNVFTRIQLALFGEVPWDATPVMPVELMLLPRKAFFSVWNMSYWSRAVIAPLLVLNALRPKAINPRGIHVQELFVKPPSEVKDWIRGPYRSVWGRFFKHLDSALRPVLPLIPRSVHKKALKAASDFIEPRLSRGGLGAIYPAMANVVMMYRAQGVPDSDPRAKTAWDAIQDLLVDHGDEIYCQPCVSPVWDTGLSGLAMIEAASGPAGTKTKETLAALKKSAEWLREHQILDVKGDWAINAPDLRPGGWAFQYENDYYPDVDDTAVVAMLLHRVDPENSREAISRAREWIIGMQSTNGGWGAFDIDNDHELLNHIPFSDHGALLDPPTADVSARCISFLAQLGDPDDRPVILKAIEYLRSEQEPEGCWFGRWGTNYIYGTWSVLCALNIAGVPHDDPMVLRAVNWLESVQRPDGGWGEDCATYEGGTAGTYKKSLPSQTAWAVLALMAVGRRESEAVKRGVAYLVSQQNEKGEWQEEAYNAVGFPKVFYLRYHGYKQFFPLTALARYRNLGVSNSGKVEYGF

SEQ ID NO: 157 - protein, 651 aa, Granulibacter bethesdensis
MPKDIPADLASEAISGDMLEQAVLRASMALHRKQQTDGHWVFELEADATIPAEYVLLEHFLDRIDDDLERKIGVYLRRIQGDHGGWPLFHEGAFNLSASVKAYYALKAIGDDPDAPHMRRAREAILAAGGAERSNVFTRIQLALFGQIPWRGVPVMPAELMIAPKWFPINMWKVSYWSRTVIAPLLVLMDRKPKARNPRNVHVRELFLHDPDRIRDWIRGPFRSGWGHFFKYLDSVLRVVEPVALKPMRPRSIRLAVDFVRERLNGEDGLGAIYPAMANSVMMYDVLGYSPDHPEAAIAWESVRKLLVIKEDEAYCQPCLSPIWDTGLSGHAMAEAEGAVSPGVAAACDWLRNRQITDVVGDWAEIRPGVQPGGWAFQYNNAHYPDVDDTAVVAMLLHRQGDPAHEESIRKAREWIIGLQCRDGGWGAFDADNDKDYLNHIPFADHGALLDPPTADVTARCISFLAQLGNPEDKPVIDRAMAWLRKEQEADGSWFGRWGTNYIYGTWSVLCAMNVAGMPHDDPAIRRAVNFLVATQREDGGWGEDEETYDPASGAQPGRYKESTPSQTAWALIGLMAAGEAEHEATRRGIAYLQATQKPDGEWDEAAYTAVGFPRVFYLKYHGYRQFFPLMALSRYKNLRSSNMKKVSFGF

SEQ ID NO: 158 - protein, 665 aa, Hyphomicrobium denitrificans
MTTNAAATSARSGEDAIRQVSGQQLETAIASARNSLLALQRPDGHFVFELEADATIPAEYVLMRHYLAEPVDAVLEEKIARYLRRIQSDDGGWPLFRDGASNISASVKAYYALKMIGDAPNAPHMQKARAWILAQGGASHSNVFTRNLLALFGAIPWSGVPVMPVEIMLLPKWFPFHIDKISYWARTVLIPLTVLNALKPVARNPKGVGIAELFVTPPDQVRNWPKGPHQKFPWSQVFGGIDRVLRLFEPAFPKSLRKKSIDKAVAFATERLNGEDGLGGIFPAMVNALLVYDALGYPHDHPDYVTARGSIEKLLVIKDDEAYCQPCLSPVWDTALAVHALMESGVAQADQNVDRALAWLKPLQVLDTVGDWAASRPGVRPGGWAFQYANAYYPDVDDTAVVVMAMDRAAGGDAAKRDHYRESMARGREWVAGVQSKNGGWGAFDADNTYEYLNQIPFSDHGALLDPPTADVSARCVSMLAQLGERRETSPVLDKAMRYLESTQEKDGSWYGRWGMNYIYGTWSVLCALNAAGVAPSAPSMRKAADWLLSIQNSDGGWGEDGESYSLDYKGYEPAPSTASQTAWALMGLMAAGEVDHPAVQRGVAYLAAKQGSDGFWGEERFTATGFPRVFYLRYHGYSKFFPLWALARYRNLNAANSKSVLVGM

SEQ ID NO: 159 - protein, 694 aa, Leptospirillum ferrodiazotrophum
MSGQSNFTGGKKMTPAEGSSSPAPALLEKAAPSIELDERSDPLSRTLARAVSWLVAAQDGAGHWVAPLEADATIPSEYVFLHEVLGRPLDPVRRDKIVRAILSVQGKEGAWPLFHDGDPDISATVKAYQALKLCGFDPSHPALVRAREWVLSQGGAGKVNVFTRIALAIFGQYSWTKIPALPAEMVLLPSWFPFSIYSVSYWSRTVIVPLLFIYHHKPLVRLSPERGISELFDPARPDGESFAPSPDFFSLRNLFLLLDKVLQVWNRHPPGFLRKKALSFAMEWMVPRLKGEGGLGAIYPAMANSAVALSLEGYELDHPLMQRVLASIDDLLIEGEKEVLVQPCVSPVWDTALAMGALIEAGISPDSPTVDRAMEWFCAREVRTRGDWAIRAPDCEPGGWAFQFENDYYPDVDDTAMVLMGMAKILPARPDLAARMEGVFRRATLWVMAMQGTDGGWGAFDRDNDLLFLNHIPFADHGALLDPSTADLTGRVLELLGALGYGPDFPPAARAIRYLRREQEEDGSWFGRWGVNYIYGTWSVVAGLKSIGVPMSEPWVMRSMEFLLARQNPDGGWGEDCLSYASRDFAGRGASTPSQTAWALIALLHGGHAGHMAVRQGVDYLIQQMTPEGTWNEELFTGTGFPRVFYLRYHMYRHYFPLWALALYRNMTERGRALGHERVDFWKTAPYAPIARSV

SEQ ID NO: 160 - protein, 683 aa, Leptospirillum rubarum
MKGKEPTREELLSFSSGIQMDSSAENTTPVSTEELQEKVRLAAESLISRQVEEGYWVEPLEADVTITSEYILLQYLLGRERDEFFRRAAPFILESQGEDGGWPLYHGGPAEISATVKAYLALKLLGYDADHPAMQRARALVLERGGAINVNVFTRITLALFGQYDWKGVPALPPEMILLPRWFPLSIYTVSYWSRTVIVPLLFIYHYKPLLELPPEKGVQELFITPMSEVRVHYAWDKHWVSWKNLFFVLDRILQAWNRHPPSFLRRKALKKAMEWMIPRLKGEGGLGAIYPAMANSVLALRLEGYAMDHPLVRRAIQSIDDLVFDLGEQQSVQPCHSPIWDTALALGALYEAGLDEGSPFVSRALDWFCRKEVRTVGDWSVRVPGVEAGGWAFQFENDYYPDIDDTSVVLMDFAKWVPEMGAYRDVFRRAIEWTLSMQGTDGGWGAFDKDNDFLFLNNIPFADHGALLDPSTSDVTGRVTELLGILGYDARTPVVRRALRFLRKEQEENGSWYGRWGVNYIYGTWSVVSALKAVGEDMSAPYVQKAMQFLFSRQNPDGGWGESCYSYFRKDTAGEGVSTSSQTAWALIALIHGGHVRHPAVSKGIDFLLSRQQADGKWLEQEYTGTGFPKVFYLRYNMYRDYFSLWALSLYRNVLLDGQSRVERLARRWKGNPYPVRSRFLA

SEQ ID NO: 161 - protein, 683 aa, Leptospirillum sp.
MEGKDPTREELLSFTSGIQMDSRVGNTNPVSTEELQEKVRLAAESLISRQGEEGYWVEPLEADITITSEYVLLQYLLGRERDEFFRRAAPFILESQGEDGGWPLYNGGPAEISATVKAYLALKLLGYDADHPAMQRARALVLERGGAINVNVFTRITLALFGQYDWKGVPALPPEMILLPRWFPLSIYTVSYWSRTVIVPLLFIYHYKPLLELPPEKGVQELFITPMSEVRVHYAWDKHWVSWKNLFFVLDRILQAWNRHPPSFLRRKALKKAMEWMIPRLKGEGGLGAIYPAMANSVLALRLEGYEMDHPLVRRAIQSIDDLVFDLGEQQSVQPCHSPIWDTALALGALYEAGLDEGSPFVSRALDWFCRKEVRTVGDWSVRVPGVEAGGWAFQFENDYYPDIDDTSVVLMDFAKWVPEMGAYRDVFRRAIEWTLSMQGTDGGWGAFDKDNDFLFLNNIPFADHGALLDPSTSDVTGRVTELLGILGYDARTPVVRRALRFLRKEQEENGSWYGRWGVNYIYGTWSVVSALKAVGEDMSAPYVQRAMQFLFSRQNPDGGWGESCYSYFRKDTAGEGVSTASQTAWALIALIHGGHVRHPAVSKGIDFLLSRQQADGKWLEQEYTGTGFPKVFYLRYNMYRDYFSLWALSLYRNVLLDGQSRVERLSRRWKGTPYPVRSRFLA

SEQ ID NO: 162 - protein, 683 aa, Magnaporthe grisea
MSPFLQASDDNNPLFKESCQALDHATEFARDTLVNKEHWCGWVLSNVTVTAEWIFLQYILGLEMSNEDRRGFLKHFTSSQRPDGSWSLATQTTTGGELSCTIEAYLALKILGVSPEEDYMVRARDYVRSHGGAEKMRMLSRFHLAMFGLIPWAAVPQMPPELIFMPSWSLVNIYKFSSWARCNIVGLCMLRVHEPLYALPNGKQLDNDYLDELWLDPYHKAIPYTVPYLQLMQTSPLGVLFQLGDLFLWLLSFLGFWFLRRWAVSSSIQWTLDHQEPSGDWGGIYPPMHHNILALMLEGWSQDDPVIQRGIGACQRFLAEDPAHGKWMQPSVSPVWDTFLMIRAVADAKTTDDADKLLVKPVDWVLAQQIDDDHIGDWRIYRPDIPAGGFAFEYFNKWYPDVDDTAVGVVALMRHDPSLVNDDRILKAAAWTLGMQNRDFGWAAFDADNNAFYLHATPFSDMDSLTDSSTPDVTGHVLEMLGLMYRLERQGRVKSPEMLAFLSQSHGACDRGLGYLLGSQEAFGGWYGRWGVNYIFGTSAALCALAYFADRKGVRGKMAAGADWLRSRQNPDGGWGELLESYDNKALAGRGRSTPSQTAWALQGLLELEDPRGEVVEAGVNWLLRHQVTSPSRNSGRVSATWPEDDYTATGFPGHFYLKYELYCHYFPMMALARYRSCIQDGA

SEQ ID NO: 163 - protein, 667 aa, Magnetospirillum magnetotacticum
MREAAVSKVETLQRPKTRDVSLDDVERGVQSAARALTDMTQADGHICFELEADATIPSEYILFHHFRGTEPRAGLEAKIGNYLRRTQSKVHGGWALVHDGPFDMSASVKAYFALKMIGDDIEAPHMRAVRKAILQRGGAANANVFTRILLALYGEVPWTAVPVMPVEVMHLPKWFPFHLDKVSYWARCTMVPLFVIQAKKPRAKNPRGVGVAELFVTPPDSVRTWPGSPHATWPWTPIFGAIDRVLQKTQDHFPKVPRQRAIDKAVAWVSERLNGEDGLGAIFPSMVNSVLMYEVLGYPPDHPQVKIALEAIEKLVAEKDDEAYVQPCLSPVWDTALTSHAMLEVGGTQAEANARAGLDWLKPLQILDIKGDWAETKPNVRPGGWAFQYANPHYPDLDDTAVVVMAMDRAQRQHGLVSGMPDYSTSIARAREWVEGLQSADGGWAAFDADNNHHYLNHIPFSDHGALLDPPTADVTARVVSMLAQLGETRETSRALDRGVTYLLNDQEKDGSWYGRWGMNFIYGTWSVLCALNAAGVDPQSPEIRKAVAWLIRIQNPDGGWGEDASSYKLNPEFEPGYSTASQTAWALLALMAVGEVDDPAVARGVNYLMRTQGADGLWNEERYTATGFPRVFYLRYHGYPKFFPLWAMARFRNLKRGNSRQVQFGM

SEQ ID NO: 164 - protein, 691 aa, Methylacidiphilum infernorum
MHSGRVFLEKENREENRATFHSSPLILVEESLNLPKKVEETIKKAQRYLLSIQKEDGHWVGELFVDVTLACDCIHLMHWRGKIDYKKQLRLVKHIVDRQLPDGGWNIYPGGPSEVNATVKAYFALKLAGFSPDDPLMAKARSTILRLGGIPKCMTYTKLGLALLGVYPWDRLPVIPPEIILFPNWFPFNIYEISAWSRAMLVPLSVIHHFKPTRNLPEKYQLHELFPYGTEHGKFSWLKKGARYLSKQGLFLACDKFLQYWDKTSLKPFRKMALKKAEKWLLERISAGSDGLGAIFPAMHYAIMALIAMGYTEDNPILKKAIADFEGLEVDDKKNDDLRIQPCLSPVWDTAVGLVALAESGVARNAKELKRAAYWLLDREIKIKGDWHVRNPHPEPSGWAFEYNNVYYPDVDDTLMVLLALRLIDIEDKIRKEEVMQRALRWVISFQCKNGGWAAFDKDVYKKWLEDIPFADHNAILDPPCSDITARALELFGKMGIKKTERFVQKAIAYLKETQENDGSWMGRWGVNYIYGTWQALRGLQAIGENMNQEWILRARDWLESCQNEDGGWGETPASYDNPQLKGKGPSTASQTAWAVSGIMACGDIFRPSVSRGIKYLCDRQLSDGSWAEEFLTGTGFPGVFYLKYDMYRNAWPLLVIGEYHRQYLKAKEQVSYWVDGTIGRKVKKERLPEI

SEQ ID NO: 165 - protein, 667 aa, Methylobacterium chloromethanicum
MREAAVSKVETLQRPKTRDVSLDDVERGVQSATRALTEMTQADGHICFELEADATIPSEYILFHQFRGTEPRPGLEAKIGNYLRRTQSKVHGGWALVHDGPFDMSASVKAYFALKMIGDDIEAPHMRAVRKAILQRGGAANANVFTRILLALYGEVPWAAVPVMPVEVMHLPKWFPFHLDKVSYWARCTMVPLFVIQAKKPRAKNPRGVGVAELFVTPPDSVRTWPGSPHATWPWTPIFGGIDRVLQKTQDHFPKVPRQRAIDKAVAWVSERLNGEDGLGAIFPAMVNSVLMYEVLGYPPEHPQVKIALEAIEKLVAEKEDEAYVQPCLSPVWDTALNSHAMLEAGGHQAEANARAGLDWLKPLQILDIKGDWAETKPNVRPGGWAFQYANPHYPDLDDTAVVVMAMDRAQRQHGLVSGMPDYSESIARAREWVEGLQSADGGWAAFDADNNHHYLNHIPFSDHGALLDPPTADVTARVVSMLSQLGETRATSRALDRGVTYLLNDQEKDGSWYGRWGMNFIYGTWSVLCALNTAGVDPQSPEIRKAVAWLIRIQNPDGGWGEDASSYKLNPEFEPGYSTASQTAWALLALMAAGEVDDPAVARGVNYLVRTQGQDGLWSEERYTATGFPRVFYLRYHGYPKFFPLWAMARFRNLKRGNSRQVQFGM

SEQ ID NO: 166 - protein, 645 aa, Methylobacterium chloromethanicum
MNTEPRFSAPETLRAIAGAGRALGRHQRRDGHWVFELEADATIPAEYVLLEHYMDRITPERQARIGAYLRRIQGEHGGWPMFHAGEFNISASVKAYCALKAIGDDPQAPHMVRARQAILGHGGAERANVFTRIQLALFGAIPWRGVPVMPVEIMHLPKWFFFNIWAMSYWARTCVVPLLVLQARKPRARNPRQVSFDEIFRTEPDEVRDWIRGPYRSRWGVVFKHIDTVLRWTEPLFSKVARESAIFKAVDFVEERLNGEDGLGAIYPAMAYALMMYDVLGYPEDDPRCVTIWKAIDKLLIETDEEVYCQPCVSPVWDTSLSGHAMIEAARTGGIEAQAELDAACDWLVARQVKDVRGDWAETRPDAEPGGWAFQYRNDHYPDVDDTAVVAMLLHRNGRPEHAEAIEKARRWVVGVQSRNGGWGAFDADNDREFLNHIPFSDHGALLDPPTADVTGRCISFLSQLGHEEDRPVIERALAYLRAEQERDGSWYGRWGTNYVYGTWTVLCGLNAAGIPHDDPMVRRAVDWLVSIQRADGGWGEDERSYDVGHYVENAESLPSQTAWAMLGLMSVGQADHPAVLRGAAYLQRTQGPDGEWQERAYNAVGFPRVFYLKYHGYRLFFPLFALSRLHNLQRGNSREVSFGF

SEQ ID NO: 167 - protein, 667 aa, Methylobacterium extorquens
MREAAVSKVETLQRPKTRDVSLDDVERGVQSATRALTEMTQADGHICFELEADATIPSEYILFHQFRGTEPRPGLEAKIGNYLRRTQSKVHGGWALVHDGPFDMSASVKAYFALKMIGDDIEAPHMRAVRKAILQRGGAANANVFTRILLALYGEVPWVAVPVMPVEVMHLPKWFPFHLDKVSYWARCTMVPLFVIQAKKPRAKNPRGVGVAELFVTPPDSVRTWPGSPHATWPWTPIFGGIDRVLQKTQDHFPKVPRQRAIDKAVAWVSERLNGEDGLGAIFPAMVNSVLMYEVLGYPPEHPQVKIALEAIEKLVAEKEDEAYVQPCLSPVWDTALNSHAMLEAGGHQAEANARAGLDWLKPLQILDIKGDWAETKPNVRPGGWAFQYANPHYPDLDDTAVVVMAMDRAQRQHGLVSGMPDYSESIARAREWVEGLQSADGGWAAFDADNNHHYLNHIPFSDHGALLDPPTADVTARVVSMLSQLGETRATSRALDRGVTYLLNDQEKDGSWYGRWGMNFIYGTWSVLCALNAAGVDPQSPEIRKAVAWLIRIQNPDGGWGEDASSYKLNPEFEPGYSTASQTAWALLALMAAGEVDDPAVARGVNYLVRTQGQDGLWSEERYTATGFPRVFYLRYHGYPKFFPLWAMARFRNLKRGNSRQVQFGM

SEQ ID NO: 168 - protein, 663 aa, Methylobacterium nodulans
MGKVETLHRMSTQDITLDDVERRVSLASKALMRLAGPDGHWCFELEADATIPSEYILYHHFRGSIPSAELEGKIANYLRRTQSAQHDGWSLVHDGPFDMSATVKAYFALKMIGDSIEAPHMRRAREAILRRGGAAHANVFTRTLLALYGEVPWSAVPVMPVEVMLLPRWFPFHLDKVSYWARTVMVPLFVLQAKKPRARNPRGIGIQELFVEPPERVKRWPAGPQESSPWRPVFAAIDKVLQKVEGSFPAGSRARAIDKAVAFVSERLNGEDGLGAIFPAMVNAVLMYEALGYPEDHPLVATARSSVEKLVTVKEHEAYVQPCLSPVWDTALSAHALMEAGGVEAERHAKRALDWLKPLQVLDIKGDWAASKPNVRPGGWAFQYANPHYPDLDDTAVVVMAMDRAQVRRSPGPDAADYGQSIARAREWVEGLQSRDGGWAAFDADNTYHYLNYIPFSDHGALLDPPTADVTARCVSMLAQLGETRESCPPLDRGVAYLLADQEADGSWYGRWGMNYIYGTWSVLCALNAAGVDPASEPVRRAVNWLTTIQNPDGGWGEDAASYKLEYRGYERAPSTASQTAWALLGLMAAGEADSPAVARGINYLTRSQGADGLWTEDRYTATGFPRVFYLRYHGYAKFFPLWALARYRNLQQSNSRRVAVGM

SEQ ID NO: 169 - protein, 667 aa, Methylobacterium populi
MREAAVSKVETLQRPKTRDVSLDDVERGVQNAARALTEMTQTDGHICFELEADATIPSEYILFHQFRGTVPRDGLEAKIGNYLRRTQSKVHGGWALVHDGPFDMSATVKAYFALKMIGDDIEAPHMRAARKAILQRGGAANANVFTRILLALYGEVPWAAVPVMPVEVMHLPKWFPFHLDKVSYWARCTMVPLFVIQAKKPRAKNPRGIGVAELFVTPPDSVRTWPGSPHATWPWTPIFGAIDRVLQKTQDHFPKVPRQRAIDKAVAWVSERLNGEDGLGAIFPSMVNSVLMYEVLGYPPDHPQVKIALEAIEKLVAEKDDEAYVQPCLSPVWDTALTSHAMLETGGAAAEANARAGLDWLKPLQILDIKGDWAETKPNVRPGGWAFQYANPHYPDLDDTAVVVMAMDRAQRQHGLVSGMPDYSASIARAREWVEGLQSADGGWAAFDADNNHHYLNHIPFSDHGALLDPPTADVTARVVSMLSQLGETRETSRALDRGVTYLLNDQEKDGSWYGRWGMNFIYGTWSVLCALNAAGVDPQSPEIRKAVAWLIRIQNPDGGWGEDASSYKLNPEFEPGYSTASQTAWALLALMAVGEVDDPAVARGVNYLMRTQGQDGLWNEERYTATGFPRVFYLRYHGYPKFFPLWAMARFRNLKKGNSRQVQFGM

SEQ ID NO: 170 - protein, 665 aa, Methylobacterium radiotolerans
MREAVSKVEALQRSKTQGISLEDVERGVAQATRALTALAHDDGHICFELEADATIPSEYILFHHFRGTQVPGDLEAKIGNYLRRTQGRHGGWALVHEGPFDMSCTVKAYFALKMIGDDIEAPHMRRAREGILSRGGAANANVFTRFMLALYGEVPWRAVPVMPVEVMFLPKWFPFHLDKISYWARTTVVPLFVLQATKPRARNPRGISVQELFVTPPESVRSWPGSPHATWPWTPIFGFIDRVLQRVENHLPRKSRQRAMEMARAWVSERLNGEDGLGAIFPAMVNSVLMYEVMGYRPDHPQVRVACDAIEKLVVEKADEAYVQPCVSPVWDTALASHALLEAGGPEAEAQARAGLDWLKPRQVLDIVGDWAARKPKVRPGGWAFQYANAHYPDLDDTAVVVMAMDRAMHQHGLVAGMPDYKASIARAREWVEGLQSEDGGWAAFDADNNHMYLNHIPFSDHGALLDPPTADVTARVVGMLSQLGETRETSRALDRGVNYLLNDQEEDGSWYGRWGMNFIYGTWSVLCALNAAGVDPADPRIQKAVSWLIRIQNPDGGWGEDASSYKIDPAFEPGSSTASQTAWALLALMAAGAVDDPAVTRGINFLTRTQGADGFWKEERYTATGFPRVFYLRYHGYPKFFPLWAMARFRNLKRGNSRRVQFGM

SEQ ID NO: 171 - protein, 663 aa, Methylobacterium sp.
MGKVETLHRTSTQDITLDDVERRVTLASKALMRLANADGHWCFELEADATIPSEYILYHHFRGSIPTAELEGKIAAYLRRTQSAQHDGWALIHDGPFDMSATVKAYFALKMVGDPIDAPHMRRARDAILRRGGAAHANVFTRIMLALYGEVPWTAVPVMPVEVMLLPRWFPFHLDKVSYWARTVMVPLFVLQAKKPRARNPRGIGIRELFVEAPERVKRWPAGPQESSPWRPVFAAIDKVLQKVEGFFPAGSRARAIDKAVAFVSERLNGEDGLGAIFPAMVNTVLMFEALGYPDDHPFAVTARSSVEKLVTVKEHEAYVQPCLSPVWDTALAAHALMEAGGTEAERHAKRAMDWLKPLQVLDIKGDWAASKPDVRPGGWAFQYANPHYPDLDDTAVVVMAMDRVQSRRSPGPDAADYGLSIARAREWVEGLQSRDGGWAAFDADNTYHYLNYIPFSDHGALLDPPTADVTARCVSMLSQLGETRETCPPLDRGVAYLLADQEADGSWYGRWGMNYIYGTWSVLCALNAAGIDPACEPVRRAVTWLTAIQNPDGGWGEDASSYKLEYRGYERAPSTASQTAWALLALMAAGEADNPAVARGINYLTRTQGADGLWAEDRYTATGFPRVFYLRYHGYAKFFPLWALARYRNLQRGNSLKVAVGM

SEQ ID NO: 172 - protein, 672 aa, Methylocella silvestris
MDDRVGAATFEAQPRAGFGSVEAAISRAREALLAVQKPDGHFVFELEADVSIPAEYILFRHFLGDPAKTEIERKIGVYLRRRQTAAGGWPLFAEGVFNVSSSVKAYFALKIIGDDPNAPHMAKARNAILAHGGAAQSNVFTRSLLALYGEVPWRAVPAMPVEIMHLPRWFPFHLSKVSYWGRTVIAPLIVVHALKPRAKNPRKISVSELFVAPAETVSRWPGAPHKSFPWTTIFGAIDRVLHKTEPLLPARSHQTAIDKAVAFVTARLNGEDGLGAIYPAMAYSAMMFFALGAPLSDPRIVQIRKAIDRLLVIKDGEAYCQPCVSPVWDTALASHALMESAGQRPEARTAPAAAAVFEALDWLKPLQVLDVKGDWATQNPDVRPGGWAFQYANPHYPDLDDTAVVVLAMDRAVKTSPLIAGEEETAYVEAISRAREWILGLQSANGGFGAFDADNDRDYLNYIPFADHGALLDPPTADVTARCVSMLGQLGERPETSPALARAIDYLLSEQEEEGSWFGRWGMNYIYGTWSVLSAFNAVERPADCAATRKAAAWLKRIQNPDGGWGEDGESYALGYKGYNPAPSTASQTAWALLALMAAGEVDAPEVALGLDYLVSTQADDGFWDEARFTATGFPRVFYLRYHGYAKFFPLWAMARYRNLKSGNRLKTQFGM

SEQ ID NO: 173 - protein, 654 aa, Methylococcus capsulatus
  misc_feature (591)..(591): Xaa can be any naturally occurring amino acid
MLREATAISNLEPPLTASYVESPLDAAIRQAKDRLLSLQHLEGYWVFELEADCTIPAEYILMMHFMDEIDAALQAKIANYLRHHQSADGSYPLFRGGAGDISCTVKVYYALKLAGDSIDAPHMKKAREWILAQGGAARSNVFTRIMLAMFEQIPWRGIPFTPVEIMLLPKWFPFHLDKVSYWSRTVMVPLFILCSHKVTARNPSRIHVRELFTVEPQKERHYFDHVKTPLGKAILALERFGRMLEPLIPKAVRKKATQKAFDWFTARLNGVDGLGAIFPAMVNAYEALDFLGVPPDDERRRLARESIDRLLVFQGDSVYCQPCVSPIWDTALTSLTLQEVARHTADLRLDAALSKGLKWLASKQIDKDAPGDWRVNRAGLEGGGWAFQFGNDYYPDVDDSAVVAHALLGSEDPSFDDNLRRAANWIAGMQSRNGGFGAFDADNTYYYLNSIPFADHGALLDPPTADVSARCAMFLARWVNRQPELRPVLERTIDYLRREQEADGSWFGRWGTNYIYGPGAVLLAYEGRRVPNDDPSVRRAVAWLKSIQREDGGWGEDNFSYHDPSYRGRFHTSTAFQTGFALIALMAAGEXGSPEVQAGVDYLLRQQRPDGFWNDECFTAPGFPRVFYLKYHGYDKFFPLWALARYRNERYALA

SEQ ID NO: 174 - protein, 635 aa, Microcystis aeruginosa
MQIQDKITEIAAKTAKAIELSQNYLLSTQYSEGYWWAELESNVTITSEAILLHKIWKTDKKRPLDKAATYLRQQQCPNGAWELFYGDGGDLSTTVEAYMGLRLLGIPANDPALEKAREFILAKGGISKTRIFTKMHLALIGCYDWQGVPSIPAWIMLLPENFPFTIYEMSSWARGSTVPLLIVFDKKPVYKMGFNLDELYTEGVNNVKYELPKNNNWSDVFLWLDGLFKWAEKTDLVPFRQESLKAAEKWVIERQEDTGDWGGIIPAMLNSLLALKALDYDVYDPIVARGLKAVDNFAIETDNTYCVQPCVSPVWDTAWVIRSLIESGLNPAHPAMIKAGQWLIDQQILDYGDWAIKNKIGTPGGWAFEFDNRWYPDLDDSAVVVMALELIKMPDENIKTSVMKRAVNWMATMQCKAGGWGAFDIDNDQNWLNSLPYADLKAMIDPNTADVTARVLEMLGTCDVKMGENRVKKALDYLEKEQEADGSWFGRWGVNYIYGTSGALSALAFLEPNQYRQQLQKGANWLSSCQNVDGGWGETCFSYNNPKFKGQGNSTASQTAWALIGLLAVGKVTGNYQREVIEKGVNYLLVTQKENGTWDEDYFTGTGFPCHFYLKYHFYQQYFPLLALGRYRALI

SEQ ID NO: 175 - protein, 695 aa, Neosartorya fischeri
MLQTEAITTEGLRFRSLAPDDPLLPRVKQALKLSGQHSREEMHSDGHWCGEVKTNATTSAEHVLLCQALDINLDADREAFISWFRCTQGADGGWSTAPDQAGDISVTVEAYLALKILGLSEDDAAMRSARDFAIAAGGVARVRIFTRIYLAMFGLFPWAAVPELPPELILLPSRVPVSIYHWSAWARATVVPLLIISHHRPIYALPGGKATCSDYLDELWCDPRNKMVPYNHDKPTAWRSDPFALIFTLADSILHRLDGLRSFNPLRRFALRKCVDWILEHQEDMGDIGDIMPPLHGAMLALRLEGYPLHSDPIHRGLEAIERFAYRDQQGKRIQTTVSAFWDTSLMLVALGDAGMASSPWLTRSLGWLQQHQRLGNYGDWKVNNPGLKAGGFSFGYFNTWYPDVDDTASAVLAIIRQDERLVCSASVLDALNWLLGMQNTDGGWGAFDRDNNKLFLNKIPFSDMEAFCDPSTPDVTGHVLEAFGIFLAVSARQQSPTKADVLTDRIVSASRRAICYLSDTHVSSGGWYGRWGCNYIYGTSAVLCALAYFGSKSDTLSGVRSVKDAVNQAIRWLETVQNQDGGWGETVNSYKDPSRAGSGPSTASQTAWAIMALLPYLPPSTEVIQRGVEYLLRTQTKTASQGATWHEKAYTGTGFPKYFYMGYSFYCHYFPMMALGRYAYPCPEWHENWRPKKE

SEQ ID NO: 176 - protein, 654 aa, Nitrobacter hamburgensis
MNSVNATVAPIDDAALGGSIGAATRGLLDLKQPDGHFVFELEADATIPSEYVLLRHYLGEPVDAALEAKIAVYLRRIQGAHGGWPLVHDGPFDMSASVKAYFALKMIGDSIDAPHMARAREAILSRGGAANVNVFTRFLLSLFEVLTWRSAPVLPIEIMLLPMWSPFHINKISYWARTTMVPLMVLAALKPRARNPRGIGIRELFLQDPATVGTPKRAPHQSPAWFTLFNSLDWILRKIEPLFPKRLRARAIEKAIAFVEERLNGEDGLGAIFPPMVNTVMMYDALGFPPEHPPRAVARRGIDKLLVIGKDEAYCQPCVSPIWDTALTCHALLEAGGPEALSGAGKSLDWLLPKQELVLKGDWAVKRPDVRPGGWAFQYANAHYPDLDDTAVVVMAMDRVRRNDRSDKYNEAIARGREWIEGMQSRDGGFAAFDADNLEYYLNNIPFSDHAALLDPPTEDVTARCVSMLAQLGETVRSSPSMAAGVDYLRRTQLKEGSWYGRWGLNYIYGTWSVVCALNAAGVDHQDPAMRKAVDWLVSIQNADGGWGEDAVSYRLDYKGFEGAPTTASQTAWALLALMAAGEVENPAVARGMKYLIDTQTKKGLWDEQRFTATGFPRVFYLRYHGYSRFFPLWALARYRNLRSTNSKVVGVGM

SEQ ID NO: 177 - protein, 651 aa, Nitrobacter sp.
MNATVAQIGDAVLEDRIGSATRGLLNLKQSDGHFVFELEADATIPSEYILLRHYLGEPVDTVLEAKIAAYLRRIQGAHGGWPLVHDGPFDMSASVKAYFALKMIGDSVDAPHMARAREAILSRGGAANVNVFTRFLLSFFEVLTWRSVPVLPVEIMLLPMWSPFHLNKISYWARTTMVPLMVLAVLKPRARNPRDVGIRELFLQDPATVRTPKRAPHQSPAWFALFSSLDWILRRIEPLFPKRLRARAMEKAIAFVEERLNGEDGLGAIFPPMVNTVMMYDALGFPPEHPPRAVTRRGIDKLLVIGEDEAYCQPCVSPIWDTALSCHALLEAGAPEALNSAGKCLDWLLPKQELVLKGDWAAKRPDVRPGGWAFQYANGHYPDLDDTAVVVMAMDRVRRNGRGDKYDEAIERGREWIEGMQSRDGGFAAFDADNLEYYLNNIPFSDHAALLDPPTEDVTARCVSMLAQLGATVDGSSSMAAGVEYLRRTQLAEGSWYGRWGLNYIYGTWSVLCALNAAGVDHQDPAIRKAVDWLLSIQNEDGGWGEDAVSYRLDYKGFEGAPTTASQTAWALLALMAAGEVENPAVTRGIKYLIDTQTKKGLWDEQRYTATGFPRVFYLRYHGYSKFFPLWALARYRNLRSTNSKVVGVGM

SEQ ID NO: 178 - protein, 654 aa, Nitrobacter winogradskyi
MNSINATAAPIDDNVLGDRIGAATRGLLSLKQSDGHFVFELEADATIPSEYILMRHYLGEPVDTVLEAKIAAYLRRIQGAHGGWPLVHDGPFDMSASVKAYFALKMAGDSIDAPHMARAREAILSRGGAANVNVFTRFLLSFFGELTWRSVPVLPVEIMLLPMWSPFHLNKVSYWARTTMVPLMVLAALKPRARNPRGIGIRELFLEDPATVGTPKRAPHQSPGWFALFTGFDRVLRLIEPLSPKWLRARAMKKAIAFVEERLNGEDGLGAIFPPMVNTVMMYDALGFPPEHPPRAVTRRGIDKLLVVGENEAYCQPCVSPIWDTALSCHALLEAGGPEAVNSAGKCLDWLLLKQELVLKGDWAVKRPDVRPGGWAFQYANGHYPDLDDTAVVVMAMDRVRRNGPNGRYDEAIARGREWIEGMQSRDGGFAAFDADNLEYYLNNIPFSDHAALLDPPTEDVTARCVSMLAQLGETVDSSSSMAAGVEYLRRTQLAEGSWYGRWGLNYIYGTWSVLCALNVAGVDHQDPVIRRAVNWLVSIQNADGGWGEDAVSYRLDYKGFEGAPTTASQTAWALLALMAAGEVENPAVARGIKYLIDTQTKKGLWDEQRYTATGFPRVFYLRYHGYSKFFPLWALARYRNLRSTNSKAVGVGM

SEQ ID NO: 179 - protein, 652 aa, Nitrococcus mobilis
MEQQPELISGGVGGVAYPWDLGSQAIEEAILAARAALLAHLHPDGYWCFELEADCTIPAEYIMMMHYTGELEAALELKLARYIRECQLQEGGWPLYYGGAMDISCSVKAYFALKLAGDDPEAAHMRRARKAVLERGGAVNANVFTHIALALFGEIPWRGVPFMPPEILLLPRWFPFHLSKVSYWSRTVMVPLFILAAHKPRARNPRAIHISELFVTDPQLETGYFKARSRLNRLFITLDALGRRIEPFIPRAVRAKALRRAAEWFITRLNGEHGLGAIFPAMVNSYEALELLGYAADHPLRQQVRKGLRDLVVEQADRAYCQPCLSPIWDTALACLALQEADRGSSSAQVRHALDWLQARQLLDTPGDWSEQHPSLPGGGWPFQFRNDHYPDLDDTAIVAWAMQRASDPERYGAAIRRATVWLLGMQSANGGFAAFDSDNTRYYLNEIPFADHGALLDPPTSDVTARVVALLGSLDGEVHDRSALNRAVAFLHREQEAEGCWYGRWGTNYIYGTWSVLTALEQLGYDFNAPWVRKAVIWLKSVQRDDGGWGESNDTYLDHRPQDRQADESTPFQTAWAVLALIAAGECRSPEVWRGVEYLLRHQRPDGLWYCPWFTAPGFPRVFYLKYHGYDAYFPLMALARYRNCVLDNDA

SEQ ID NO: 180 - protein, 659 aa, Nitrosococcus oceani
MTRALRQAPESAGAIGIAAASPATETSGQDTHPREISGAITAARDALLKLQQADGHWCFMLEADCTIPAEYILWTHFTGELEPEIERKLAARLRAKQASHGGWPLYEGGDLDISCSVKVYYALKLVGDDPNAPHMRRAREAILAQGGGARANVFTRLALAMFSQIPWRGVPFIPVEIMLLPRWFPFHLSKVSYWSRTVMVPLAILYSLKAQAQNPRNVHIQELFTVPPEQERHYFPVRSRLNKILLSVERTARLLEPLIPSMLRRRALKKAETWFTERLNGEDGLGGIFPAMVNAHESLILLGYSPDHPWRVQAKKALQNLVIEEKNSASCQPCLSPIWDTGLAALALQETEGGHTTAPVIRALDWLKERQILEQSGDWQVQHPNLKGGGWAFQYNNSYYPDLDDTALVAWSMDQAATPERYGEAIGRACDWLCGMQSRNGGFAAFESDNTHYYLNEIPFADHGALLDPPTADVTARCIVLLGRLNKPQYAETLQRALDYLRREQEPNGSWFGRWGTNYIYGTWSALTALEQANIDPQEGFIRKAVEWLKQVQRLDGGWGEDNYSYFDSSLAGRYQESTPVHTAWALLALMAVGEANSEAVKKGIAYLLQIQQEDGLWDHPAFNAPGFPRVFYLKYHGYDKFFPLWALARYRNHLNRQC

SEQ ID NO: 181 - protein, 666 aa, Nitrosomonas europaea
MSISPTFSGSSLQKSSLSDHSTISEPFTVVDRVNGISAVALDDAITRARSALLAQQREDGHWCFSLEADCTIPAEYILMMHFMDEIDTALERRIANFLRNRQVTDGHGGWPLYYGGDFDMSCSVKVYYALKLAGDSPEAAHMVRARNAILERGGAARSNVFTRLLLAMYRQIPWRGVPFVPAEIMLLPRWFPFHLSKVAYWSRTVMVPLSILCTLKAKAANPRNIHVRELFTVDPEMEKNYFPVRTPLNHLLLYLERLGSKLEPLIPSFIRRRALKKAEQWTIERLNGRDGLGAIFPAMVNAYEALTLLGYDHDHPLLQQCRLALRELLVNEGEDITWCQPCVSPVWDTVLASLALQEDERADNGPVRHALDWLVPLQALDQPGDWRNSRPDLPGGGWAFQYANPHYPDLDDTAAAAWALCQADTEDYRTSITRAADWLAGMQSSNGGFAAFDIDNVHYYLNEIPFADHGALLDPPSSDVTARCIGLLALNGEARHQETVKRGLTFLFNEQEPSGAWFGRWGTNYVYGTWSVLEALKLARVDHDHQAVKRAVQWLKSVQRADGGWGETNDSYLDSELAGQLETSTSFQTAWAVLGLMAAGEVGSTAVRNGIDYLIRTQSAAGLWEEPWFTAPGFPKVFYLKYHGYSKYFPLWALNRYRAMNSRSVV

SEQ ID NO: 182 - protein, 670 aa, Nitrosomonas eutropha
MSISQAFFRTLIQKSSLSDSSLVSENFPADDVAGNEANEISAVTLDEAITRAYTALLAQQREDGHWCFPLEADCTIPAEYILMMHFMDEVDTVLERKIANFLRTRQVTDGHGGWPLYYGGDFDMSCSVKTYYALKLAGDSPEAAHMVHARNAILERGGAARSNVFTRLLLAMYRQIPWRGVPFVPAEIMLLPRWFPFHLSKVAYWSRTVMVPLSILCTLKAKAINPRNVHVQELFVVDPVKEKNYFPVRTSLNRLLLYVERLASKLEPFIPSFIRRRAVKKAEQWVIERLNGNDGLGAIFPAMVNAYEALTLLGHDRDHPLLQQCRQSLRELLVDEGEEITWCQPCVSPVWDTVLATLALQEDKQADSEPIRRALDWIVPLQILDEPGDWRDSRPNLLGGGWAFQYANPHYPDLDDTAAVAWALIQTGAEDYRVSITRAADWLAGMQSSNGGFAAFDIDNAYYYLNEIPFADHGALLDPPTSDVSARCVGLLALNGEVRHQEAVKRGLDFLFNEQESSGAWFGRWGSNYIYGTWSVLEAFRLARVDKGHQAVQRAIQWLESVQRADGGWGETNDSYLDPQLAGQLEASTSFQTAWAVLGLMAAGEVENTAVRKGIDYLLRTQIATGLWEEPWFTAPGFPRVFYLKYHGYSKYFPLWALNRYRTLSSKSAV

SEQ ID NO: 183 - protein, 665 aa, Nitrosomonas sp. AL212
MDGSQRISDMSQQPEGIAVSDEISSAYSVSSLNQDEINVDELENKLTQARSAMLSLQKPDGHWCFPLEADCTIPAEYILMMHFMDEIDVILENKIARFIREKQDLTHGGWPLYYGGAFDISCTIKSYYALKLVGDSPDAAHMVRAREAILERGGAAKANVFTRLLLAMYEQIPWSGVPVVPTELMLLPSWFPFHISKVSYWSRTVMIPLSILCTIKARAINPRNVDIRELFIVPPEQEKNYFPQADTWLKRAFMLVERVLSRVEPKLPQAIRQYSIRKAENWTLERLNGECGIGAIFPAMVNAHESLALLGYAYDHPSRVQCRNALRGLLVDEGERAWCQPCTSPVWDTVLTCLALQEDPAADQGPVLKALDWLVDQQVLDEPGDWRDKRPDLLGGGWAFQYANPHYPDLDDTAAVAWALDQSDAQRYQKPLDRAANWLAGMQSRNGGFAAFDIDNTYHYLNEIPFADHGALIDPPTSDVTARCVGLLGKYGKHQREVWRGISFLLREQEKNGSWFGRWGTNYIYGTWSVLEAFQLANFDMQHTSVRRAVKWLESVQRVDGGWGETNDSYLDIQLAGQFPQTSTTFQTAWAVLGLMAAGEVNSKSVRRGINYLLHNQADDHLWEDPWFTAPGFPRVFYLRYHGYSKFFPIWALVRYRALTKERVS

SEQ ID NO: 184 - protein, 653 aa, Nitrosospira multiformis
MKKFGGMARTSLQAQSPGSNNTPSMDEKMLKAGLEAARGALLAQQREDGHWCFPLEADCTIPAEYILMMHFMDEVDLDLEVRIARFIREKQDVAHGGWPLYYGGEFDLSCSVKAYYALKIVGDSPDAPHMVRARAAILKHGGAARANVFTRLLLAMYDQLPWRGVPFVPVEIILFPKWFPFHTSKVAYWSRTVMVPLSILCSLKARAANPRKVAIRELFTVPPGEERNYFPVRTALNRVFLLIERTLSLLEPFIPQGVRRLALRRAESWIVERLNGDSGLGAIFPAMVNAGEALALLGYPYDHPAREQCRKALRLLLVEEGERTWCQPCVSPVWDTVLTCLAFQEDTEVDQKPIRKALDWLVPCQVLDAPADWQEDHPGLPGGGWAFQYANPHYPDLDDTAAVAWALYQADPKAYQESISRAADWLAGMQSSNGGFAAFDSDNTYYYLNEIPFADHGALLDPPTSDVSARCAGFLALYGQSRHKQALERSLAYLFNEQEASGAWFGRWGSNYIYGTWSVLEAFRLAGIDAGHPAIRRAVHWLKSVQREDGGWGESNDSYLSPQQAGQFHTSTSFHTAWALLALMGAGEWRSHEVHRGIAYLLREQDSDGLWHEPWFTAPGFPRVFYLKYYGYTKYFPVWALTRFHALNRKFPG

SEQ ID NO: 185 - protein, 638 aa, Nostoc punctiforme
MQTQDRVKVNQVAEAIAASQQYLLSIQNPAGYWWAELESNVTITAETVLLHKIWGTDQTRPLHKVEAYLRQEQRQHGGWELFYGDGGELSTSVEAYMALRLLGVPATDPAMIRAQAFILQRGGISKTRIFTKLHLALIGCYNWRGIPSLPPWIMLLPKAFPVNIYEMSSWARSSTVPLLVVCDRKPVFITDPTINLDELYAEGIDRVRWELPQSGDWTDLFLTLDQGFKWAESLNLVPFREEGIKAAEKWILERQEATGDWGGIIPAMLNSMLALRCLDYDRSDPIVERGLQAIDNFAIETDNSYRVQPCVSPVWDTAWVMRALVESGFVPDHPAVVKAGEWLLQKQILDYGDWAVKNRQGKPGAWAFEFENRFYPDVDDSAVVVMALHLAKLPNEKIKQAAIARAVNWIASMQCKPGGWAAFDLDNDQDWLNSIPYGDLKAMIDPNTADVTARVVEMLGACDLSIDSDNLERSLTYLLREQETEGCWFGRWGVNYIYGTSGVLSALALIDPQRHKLSIERGAAWLLGCQNLDGGWGETCRSYDDPSLKGKGDSTASQTAWALIGLLAAGEATGKLAVKAIEQGIGYLMATQQPDGTWFEANFTGTGFPCYFYLKYHLYQQYFPLIALGRYQAAIKES

SEQ ID NO: 186 - protein, 637 aa, Nostoc sp.
MRTQDRVQVNSIAEAIAASQKYLLSLQNPAGYWWAELESNVTITAEVVLLHKIWGTDKTRPLHKVEAYLRSQQKQHGGWELFYGDGGELSTSVEAYMALKLLGVPATDPAMIQARDFILQRGGISKTRIFTKFHLALIGCYNWRGLPSLPAWVMLLPNQFPVNIYEMSSWARSSTVPLLIVFDQKPVYQVNPTITLDELYAEGVENVRYELPRSGDWTDLFLTLDEGFKLAESFNFIPFREEGIKAAEKWIIERQEATGDWGGIIPAMLNSMLALRSLGYDTNDPIVERGLQALDNFAIETVDCYRVQPCVSPVWDTAWVIRALIDSGIAPDHPAIVKAGEWLLQKQILDYGDWNVKNRQGKPGAWAFEFENRFYPDVDDTAVVVMALHAAKLPNEQLKQKACDRALQWVASMQCKPGGWAAFDLDNDQDWLNSVPYGDLKAMIDPNTADVTARVIEMLGACNLSIDSHNLERALTYLLNEQEAEGCWFGRWGVNYIYGTSGVLSALALINPQKYQRHIQQGATWLVGCQNPDGGWGETCFSYNDPSLKGQGDSTPSQTAWALIGLIAAGEATGNFAHDAIERGINHLVSTQQPDGSWFEAYFTGTGFPCHFYLKYHYYQQYFPLIALGRYQAIKSL

SEQ ID NO: 187 - protein, 654 aa, Oligotropha carboxidovorans
MTSDTASAAALDPRRLATSITRASRALHDVQQPDSHWVFELEADVTIPAEYVMMRHYFAEPVDAEIEAKIAKYLRRMQNDNGGWSLFYGHEFDMSASVKAYYALKMIGDSPDAPHMKKAREAMLARGGASRANVFTRIMLALFGQVSWKAVPMMPVEIMLLPRWFPFHLTKVSYWARTVIVPLLVLMTLKPRAKNPRGIGVRELFLEDPQTVGPTPKAAHQSQLWFTSFDIIDRVLRITDPFFPKGMRKRAIAKAEAFVTERLNGVDGLGAIFPAMVNSIMMYDVLGYPPNDPNRALARESVERLLVIKDDEAYCQPCVSPVWDTALAAHSMLESGEAADIEAAKAGLDWLLPRQVLDLKGDWADKRPDVRPGGWAFQYNNAHYPDLDDTAVVVMAMDRVRRLDGTTKYDEAIARATEWILGLQSENGGWAAFDADNLEYYLNNIPFADHGALLDPPTEDVTARCLSMLAQLGDTLETSEPMRRGVEYLRKTQLPDGSWFGRWGINYVYGTWSVLCALNAVGVPHDDPMIAKAADWLESIQNEDGGWGEDGNSYKLNYKGYERAATTASQTAWATLALMAAGRVDRDATQRGIDNLVQSQEADGFWGEPYYTGGGFPRVFYLRYHGYSKFFPLWAMARYRNLRSSNSRFVGAGM

SEQ ID NO: 188 - protein, 609 aa, Paenibacillus sp.
MRSELLQLQSADGSWRLCFDSGTMPDSYFIIILRMLGYSQDEALIRQIASRILSRQLPNGTWKIYPDEEDGNLDATAEAYFALLYSGFLTKLDPRMQLAKQFILSKGGLSKIRSLLTQAIFAAAGQASWPKSMRIPLEVFFSDNGIGIDLFSLSGHARVHIVPIIMLANAQFVQHSASMPDLSDLFAGSSKRFENDSPWIAALATLIGSLSLSELLPFESPTPQEKAVQFLFDRLEPDGTLLTYTTATMFMILVLLMLGYSSSSPLIHRMVSGIHSVICANSHVQIASSEVWDTAMLVHALRKAGVNPTSTALENAGAYLRQRQQTQLGDWAIRNPGTPAGGWGFSNVNTLYPDVDDTTAALRAIQPYSSRTPELQADWQRGLNWVLTMRNDNGGWPAFERQGSRLPITFFNFEGAKDIAVDPSTVDLTSRTLQFLGQELGMNAGNSWIESTLRWVLSQQESNGSWYGRWGITYVHGTSAALQGLTAVGIAEDHPAVKKGVDWLLQVQNEDGGWGESCISDKVRRYVPLNFSTPSQTAWALDGLTAALPKPTPALERGVDALLQSLDRHDWTYTYPTGGALPGSVYAHYASNNYIWPLLALSNIWQKYS

SEQ ID NO: 189 - protein, 609 aa, Paenibacillus sp. JDR-2; identical to SEQ ID NO: 188

SEQ ID NO: 190 - protein, 642 aa, Paenibacillus sp. oral taxon 786
MALSNGEIREEIQRLSEELIQRQEPDGSWRFCFENGITIDACTIILLRTLNVDKEELIRQLHDRIVAAQQPEGCWRWYHDDKEGHLSATVEAYYALLCSGYSRPEDEPIQRAKRYILDRGGIGQARSLFTKAILAATGQRKWPASLSLIPIEILLLPESLPLNFYDFSGYSRVHLVPLLIMAERNFRTRSVRTPDLSELFLDARNGEEDPLTLTPESREPLKLIQSGLAHLVGTPRRIRQAAVNRAEQYMLDRIEGDGTLYTYASCTVLMVFALLALGYEPQHPVIQRAVEGLSQMKFTVDSTGQGGTRYVTIQNSPSTVWDTALISYALQEAGVSSSHPAIQRAADYLRNRQHRRPGDWQIHNPGIVPGGWGFSETNTFVPDVDDTTAALRALSALHGSEPAVLGAWNRGLNWVWSMQNNDGGWPAFEKNTNKEMLTWLAIEGAKSAATDPSEADLTGRTLEYLGNFAKLSVRQDWVARGADWLLSHQEADGSWYGRWGICYIYGTWAALTGLMAVGMPADHPGIAKAANWLIRIQNADGGWGESCRSDQVRRYVPLHASTPSQTAWALDALIAVHDRRAPEIERGVARLIALLHEDDWPSTYPTGAGLPGYFYVHYHSYRYIWPLLALSHYVNKYGDSSP

SEQ ID NO: 191 - protein, 603 aa, Paramecium tetraurelia
MIKKILVLILLMVVVTSKVDIERVQTVIRDAREICWNELTDNEWVYPTYLGTLFLSEYYFELKALGIQNSQFEESKFTQILLGSQLPDGSWVQVEDAYIQTGQLDATIFNYWYLKAVGIDIHTDTMKKAQEWIKANGGIEKAQTMTKFKLAMFGQYPWKKLFKIPLILFYKKFNPLYIKDITAQWVYPHMTALAYLQNQRIIFNVAVSISELYKNKAPKIKNHQKKGRPSFFINNLVQEMLKLRQPMGSFGGYTVSTLLSMLALNDYTGRTNKHKSEISDALKKGLDFVEFNYFNFRQAYHGSLDDGRWWDTILISWAMLESGEDKEKVRPIVENMLQKGVQPNGGIEYGYDFGYAPDADDTGLLLQVLSYYGTDYADAMDKGAEFVYSVQNTDGGFPAFDKGKMGKNPLYKYAFKIAGIADSAEIFDPSSPDVTAHILEGLISSDRSNYDVVVKSLKYFMDTQENFGSWEGRWGINYIYAAGAVLPALKKMNNGWAKAVNWLVSKQNADGGFGETTLSYRDPKKYNGIGVSTVTQTSWGLLGLLAVEDHYDVKEAIEKARDGEFKDISVVGTGHRGLLYLQYPSYARSFPVISLGRFLDQQR

SEQ ID NO: 192 - protein, 737 aa, Pelobacter carbinolicus
MDKIKMKNINQPKFRVFRGGQKAATPCPGTTNERRGALDRGRLSASLKHSREWLLSLQADAGNWVFALEADTTIASEYVMLQRFLGRPLAPELQQRLANYLLSRQLPDGGWPLYAEDGFANISTTVKAYLALKLLGYPTHCDPLVRARQIVLALGGAEKCNVFTRIALALFGQIPWRTTPAMPVEIMLLPRWFYFHLSKISYWARTVVVPLLILYAKRPVCRLEPWEGIPELFVTPPDKLGYLDVCKPGQWRKNVFIWVDRLTRKMVRCVPRRLHNLALRAAETWTREHMQGAGGIGAIFPAMANAVMALRTLGCSPDDADYQRGLKALDDLLIDRCDVPPREDTPVSPCWCTGTSAAPMLDPSPAGSHAQGGDQGICQPCASPIWDTGLALTALLEGGLDARHPAVDRAVRWLLDQQVDVKGDWAQRVPNLEAGGWAFQFENALYPDLDDTSKVLMSLIRAGAMDNPGYRQELSRAINWVIGMQNSDGGWGAFDVDNNYLYLNDIPFADHGALLDPSTADVTGRCIEMLAMAGFGRDFLPIARGVDFLRREQEDFGGWYGRWGVNYIYGTWSALSGLIHAGEDLQAPYIRQAVGWLESVQNPDGGWGETCYSYDDPALAGRGVSTASQTAWALLGLMAAGEVDNLAVRRGIQYLVEEQNRAGGWDERHFTGTGFPRVFYLRYHGYSQYFPLWALGLYERLSSGNPSRQQMVRRAGPAGLHLPVLDRRKKLRRKRKA

SEQ ID NO: 193 - protein, 695 aa, Pelobacter carbinolicus
MNVIRQLNSGVNAAKSLDDGIESAIEWLAENQDKEGFWVGMLESNSCIEAEWILAMHLLGVKDDPKYDKVVQAILNEQREDGSWAVYYDAPAGDINATVEAYAALRTAGFGAGDERLIKARNWIFSHGGLKNVRVFTRYWLALIGEWPWDETPALAPEIIYLPAWCPLNIYDFACWARATLVPLSVLSVRRPVKPLPAESRLDELFPEGRENADYSLPESEKGLAERFFLVVDWFLKKYNRLPMQFGREKAIRLCLEWIVRHQDYDGGWGGIQPPLIYSLIALNTEGYGINHPVISKGLDAFNPPWAYEKNGGVYLQCSESPVWDTLFTMLALFESGCSFDDTPMMRPALDWILSKQITSWGDWQVKVRGVRPGGWAFERANTAYPDVDDTALALVVLAEARRHVKDSAAVDAALERAEEWILGLQCRNGGWAAFDRDNNSAIVTKIPFCDFGEVLDPPSVDVTAHVVEALAALGRDRHDPVVARALKYIRSEQEPGGSWFGRWGVNHIYGTCAVLPALAAIGEDMRAPYVLRAADWLVRHQNDDGGWGESCASYMDDSQCGQGSSTASQTGWALMALVAMSSHDYDEAIRRGLDYLLSHQKSGTWDEPQYTGTGFPGYGVGERTNLKEAGATLDQGCELARGFMINYNMYRHYFPLIAMARARRHLGLAANPRHQDSRSSVEVAPEALRGRACG

SEQ ID NO: 194 - protein, 719 aa, Pelobacter propionicus
MKKATRSVFSLLDGGKISDSGSRGDSRHAGSRLDSVTKSAAALLASRQNPDGHWVFDLEADVTIPAEYVMMRCFIGEPLDSDMASRLSAYLLERQLPDGGWPLYAVDGNANISATVKAYFALKLLGHDKYAPHMVSARRMILAQGGAERSNVFTRITLALFGQVPWHTTPAMPIEIMLLPKWFFFHLSKVAYWSRTVIVPLLILYNKQPVCRLGYSEGIAELFSTSPDMLVHLDHFRYRAWRKNAFIVLDRLLKRTMHLVPGRIKRRALEEAERWTRERMKGDGSIGAIYPAMANAVMALKTLGCGDSDPDYLRGLRAIDRLLIHGKPEAGALPADGAGTLFPVLDGASSAAVDLYPASLSDTAKSHAFSFCQPCNSPVWDTALSLTALSEAGGGGYSPERAMEWLFNRQIATQGDWTERCPGLECGGWAFQYENALYPDVDDTAKVLMSLFRAGALERGEYPEKIAKAVRWVLGMQGADGGWGAFDVDNNHFYLNDIPFADHGALLDPSTADLTGRCIEMLGMLGHGPDYPPITRGIEFLREEQEPFGGWFGRWGVNYIYGTWSVLSGLSQAGEDMGRPYVRKAVEWLVSCQNDDGGWGETCASYDDPSLAGSGASTASQTAWALLGLMAAGEADHAAVRAGIAYLADSFADGWDERHFTGTGFPRVFYLRYHGYSLFFPVWALGVYARHREGGKTVQEQVRERGVNGVFDFVMGGSA

SEQ ID NO: 195 - protein, 679 aa, Pelobacter propionicus
MNPAKYKISSSLTSLNAEPVEQAPLPAKRTGSKVHRLPPSIWKKMVAEAKSPLDKGIERTRDFFLREQLPDGYWWAELESNVTISAEYVMLFHFLGMVDRERERKLANYILAKQTSEGFWSLWHNGPGDLSTTIEAYFALKLAGYSADHPAMAKARAFVLANGGIIKARVFTKIFLALFGEFAWFGVPSMPIELMLLPDWAYFNMYEFSSWSRATIIPLSVVMSERPVRKLPPRAQVQELFVRPPRPTDYTITREDGLFTWKNFFIGADHLIKVYESSPIRPFKKRAVALAENWILEHQEQSGDWGGIQPAMLNSILALHCLGYANDHPAVAKGLDALANFCIEDDDCIVLQSCVSPVWDTALALVALQEADVPADHPALVKAAQWLLNLEVRRKGDWQVKCPELEPGGWAFEFLNDWYPDVDDSGFVMLSIKNIKVRDRKHREEAIKRGIAWCLGMQSENGGWGAFDRNNTKYLLNKIPFADLEALIDPPTADLTGRMLELMGNFDYPKSHPAAERALAFLKKEQESEGPWWGRWGVNYLYGTWSVLCGLEAIGEDMNQPYIRKAVNWIKSRQNNDGGWGEVCESYFDRSLMGSGPSTASQTGWALLALMAAGEANSRAAAQGVKYLLETQNEDGTWDEDAFTGTGFPKFFMIKYHIYRNCFPLTALGRYRRLTAAKG

SEQ ID NO: 196 - protein, 669 aa, Penicillium chrysogenum
MSMTSREDHDASSLISQVEHALKLSNDYALGLVHPDGHWYGEMNTNVTVTAEYVFLRQALRLDLKTDIAAYCHYLLSQQNSDGSWGLAPEYPGDVSTSTEAYLALKILGTSPHTPAMRNARAFVLKAGGIARVRIFTRIFLATFGLFPWSAVPELPVELMLLPSICPINIYKFASWARGTIAPLLIICHHQPVYSLPNGKSTDNDYLDELWVDCTNKSVPYGLPLWDLMSQGEFAGLAFGVLDKVLYQLNGLRSIPLIRAYARKQCIQWILERQEKTGDWAGIFPPMHANMYAFTLEGYKLDDDPVRLGFQALERFAWEDEKGKRIQACVSPVWDTALMTIGLCDAMSPNKQTIDHALAWIRARQLLEPRGDWRVYRPQLAPGGFSFEYENSWYPDVDDTAAIILAQVKHDNGSIGSNSVIAAATWILGMQNPDGGWAAFDVENDKLFLNKIPFSDMDSLCDTSCADITGRILEAYGLMMMKYFSAKSDADPLLHTLRAACMRGMHYLASTQEPNGSWYGRWGCNYIYGTSHVLCGLAYFVEKRLVCVMVKSALQWLKSRQNDDGGWGESLLSYQSPDREQQASTPSQTAWALMGLLSHLPVTDDAIERGIRYLVSSQRPEKGIGSSWPQAEYTGTGFPNHFYLGYDYYRHYFPMMALGRYLQGSRGLN

SEQ ID NO: 197 - protein, 705 aa, Planctomyces limnophilus
MTSGTFGAKRVDLLAAFEHSAPAEKTRETCVGLQTAIARTRQYLLDQQHSEGFFVAELEGDTILESEYILLLAFLNEGQSPDAQAAARYLLTKQNTDGSWSNFPGGPIDVSCAVKAYLALRITGHAADEPALIRAREAILQAGGVERVNSFTRFYLAMLGLIPYSLCPAVPPEVVLLPDWFPINLSQMSAWSRTIVVPLSLLWAFQPAVELNDADGHQITIEELYASPEKQLPRFIRGVNHESNSNGWMNWSRFFFRVDQCLKSIESYGIKPLRSRAVRKCVQWILDRQEMSDGLGAIFPPIVWTLIGLKCAGFDDQHPMVQKQRDELNRLMLREQDALRLQPCLSPVWDTAISIIALRESGVEPDHPALSKARNWLLSKEVRHAGDWSKAHPETPVSGWYFEFNNEFYPDVDDTAMVLIALASTLPEEATPLAISHGVLPVQTGWSAESTSRVQALKQLENHRPVLEAMGRGVQWLKALQSKDGGWGAFDSDINKELLTKVPFADHNAMLDETNADISARVLEAYAAVGISFNDPSVQRALEFIWNDQEDDHAWYGRWGVNYIYGTWQVLVGLTAIGISAHDPRLVRAAGWLKSKQQACGGWGETPATYDNPTLRGQGTPTASQTAWAVLGLIAAGEQNSIECQRGVEFLLKTQKHNGTWDEEEFTGTGFPRVFYLRYHYYPLYFPLMALGRFARAGGRVNFAG

SEQ ID NO: 198 - protein, 697 aa, Planctomyces limnophilus
MEDLTQKLQQALQLASRALLNERVRPGLAHWEGELSTSALSTATAVMALFQYAKCQQASGRLQKVFDGKSEGDWRLIEQGLAWLLQHQLADGGWGDTDKSISNISTTMLAHATLVACREAVRQKSLVLNASDIDAAIERSGRLIEELGGIQAIRDRYGKDHTFSVPILTHAALAGLVSWNEIPALPYELALLPHRFFEVIQLPVVSYALPALIAIGQTLHLRQRTWNPWWWVRRAAIPGTLQKLQSIQPESGGFLEATPLTSFVTMCLASVGRVDHPVTQAGLKFIRDSVRPDGSWPIDTNLATWVTTLSINHLGAEAFSSDEREALMRWLLQQQYRTMHPYTNAAPGGWAWTNLSGGVPDADDTPGAMLALMELDRVSVSSQESLSIEQALYQAALWLIKLQNRDGGWPTFCRGWGALPFDRSSNDITAHCLRALIQYERRLNDVTVDATGDTTSRPLAVEVPSPKLREQMQRSIQQGFEYLEKTQREDGSWLPLWFGNQHSPDDENPLYGTARVLLAYADAGLEGSSAALRGCDWLVRHQHADGAWGPGTSIETADTSDAESDVEGEPASIEETALALMALCRFDATHNVLHRGASWLITKVENETWREPTPIGFYFAKLWYYEKLYPQVFTVGALKALALRLGSALTTVSENEPAPSSAEPPIPPIATDRVADSMHLQRTSPSINLANGGITLA

SEQ ID NO: 199 - protein, 620 aa, Planctomyces maris
MSETISCQRIQAAYQRSRAELLSLRNSTGHWTGELSTSALSTATAIMALEMIRRKRLPADLSLNTYIDNGIRWLAEHQNSDGGWGDTVKSFSNISTTMLCHAVFHATKSTEQYVSHVVNARQYIDRVGGVEAVVARYGKDKTFSVPILTHCALAGLVKWKTIPALPFELACLPARFYKTVRLPVVSYALPALIAIGQVRHHFCKPRNPITRLIRKLAVKRSLKKLISIQPSNGGFLEAAPLTSFVTMSLAGMGLTDHPVVQKGLQFLLDSVRPDGSWPIDTNLATWTTTLSVNALEGTLAEFEKTPIREWLLQQQYKELHPYTSAEPGGWAWTDLPGGVPDADDTPGAILALLNLQPDEPDTQQPADLQVALRNGVKWLLDLQNSNGGWPTFCRGWGALPFDQSAADISAHVIRALQAWLQTEPESAEAELRLRAERAVRKCFKYLATVQRPDGSWLPLWFGNQHVENDENPVYGTARVLAAYAQGEQCGSIQAEQGILFLKSVQNLDGGWGGATSAPSSVEETALAVDTLLALGLEPADPVVAQGLNWLSGRVENGTYTETTPIGFYFAKLWYFEQLYPIIFTVSALHRAETVLKKSADDNLRLSLEEEDYPIMSVKEK

SEQ ID NO: 200 - protein, 770 aa, Polypodiodes niponica
MALPFNQDSYKGDDEADVSKGAAKSPPSLEEAIQRSQEFLLAQQFPEGFWFGELEANVTIISHTVILYKLLGIEENFPMYKFERYLRRMQCSHGGWEIAYGIGSYLSATIEAYIALRLLNVPQSDPALQKALRVILDSGGVTKARIFTKICLALLGSFDWRGIPSLPPWLILCPTWFPLSIYEVSSWARGCIVPLLVILDKKPVFKVSPEVSFDELYAEGREHACKIIPISGDWTSKFFITVDRVFKMMERLRVVPFRQWGIREAEKWILERQEESGDYVNIFPAMFYSVMCMKVLGYETTDPVVQRALLGFKGFTIETADECKVQSTVSPIWDTAFIVRALVDSGIPPDHPALQKAGQWLLQKQILKHGDWAFKDRQNPVNQRGFACLQRDSQIETADECRVQSTLSPVWDTAFVVKALVDSGIPPNHPALQKAGQWLLQNQTLTHGDWAFKTQSGHLAAGGWAFQSHNRWYPDADDSAAVMMALDCIELPDEDVKNGAIARGLKWISALQSRNGGWAGYDKNCDQQWINKVPFNDLNGILDVPTADVTARVLEMVGRLSRLGAVGTPYSPRHCTLVESIPHLLLPETIARGLAYLRREQEGEGCWWGKWGVNYIYGTCGALLALSQVAPTTHQEEIARGAKWLAQVQNRCDKQKAAQGPRDGGWGESCFSYDDPALKGQNDASTASQTAWAVQGLLAAGDALGKYEVEAIEQGVQYLLATQRKDGTWHEAHFTGSCFAQHFYVRYHYYAQHFPLSALGLYRTRILQHQ

SEQ ID NO: 201 - protein, 692 aa, Polypodiodes niponica
MLPYNQNSYKEALHGGHAAHNPPTLEEAIKRSQEFLLAHQHPEGFWWGDLECNVTSASHTLILYKILGIADRYPLHKFEKYLRRMQCSHGGWEMSFGDGGYLSATIEAYICLRLLNVPQSDPALQRALKNILARGGVTKARVFTKVCLALLGGFDWAALPSLPPWLMLFPAWFPWNIYEAASWARGCVVPLIVLLEKKPVFQVKPEVSFDELYVEGRAHACKALPFSAHDWVSNIFVAADRAFKLMERFGAVPFRQWSIKEAKKWVLDRQEEMGDFIGYNPPMLYFAVCLKLWGYEVTDPLLQRALLAHKKLTVETEDECWLQSSQSPVWDTALVIPALVESGLPPDHPALQKAGQWLLEKQILKHGDWALKTGGGRMQDDIGGGWAFQFVNSWYPDVDDSAAVVIALNCIKMPDEDVKNGAIARCLKWIAFMQGRNGGWAAFDRDSNQRWMDATPFSDIEAMLDVSTADVTARVLEMVGLMRLKHAAQPANNSLGKAHRHISTESIARGVDYLTKEQEKEGCWWGRWGVNYIYGTRGALMGLSQVAAKTHKKEIARGAAWLVKVQNKKNEKKQGAQDGGWGEACFSYDDPATKGQNSRSTASQTGWAMQGLLAAGEVLGRKYEMEAVEEGVQFLLDTQRKDGSWSEAEFTGGGFPKHYYLKYHYFAQHFPLSALARYRARLLQLSRPKNQA

SEQ ID NO: 202 - protein, 355 aa, Populus trichocarpa
MVYSYEMMVLLDYPEDHPLRVECKAALKKLVVHRDDGSSYCQPCLSPVWDTAWSVMALEQAPSDARTETAIARAYDWLTDRQVLDLRGDWENNAAPSTPPGGWAFQYENPYYPDIDDSAVVLAMLHARGKRTGQPGRYEMPVARCLDWIIGLQSRNGGFGAFDANCDRDFLNAIPFADHGALLDPPTEDVSGRVLLALGITERPQDATARERCIQYLRDTQQPDGSWWGRWGTNYIYGTWSVLAGLGLAGVDRKLPMVRNGLQWLRGKQNADGGWGETNDSYARPELAGKHEDGSMAEQTAWAMLGQMAVGEGDADSVHRGAAYLLDAQNEDGFWMHPYHNAPGFPRIFHLKYHG

SEQ ID NO: 203 - protein, 673 aa, Ralstonia eutropha
MSMNEAVLAAPRAAVATAAPALQAPIEALSPLDAGIGHAVDALLAQQNADGHWVYELEADATIPAEYVLMVHYLGETPDLSLEARIARYLRRIQNADGGWPLFHEGRSDISASVKAYFALKMAGDDPQAAHMARAREVILAMGGAETSNVFTRTLLALYGVMPWQAVPMMPVEIMLLPQWFPFHLSKVSYWARTVIVPLLVLNSLRPQARNPRKVGIDELFLGSRDAVRLPPRAPHQHKGWHALFHGADVLLRTAEHVMPRGLRRRAIDAAKAFVRERLNGEDGLGAIFPAMANSVMMFDVLGVPPDDPDRAIARRSIDKLLVVHGDEAYCQPCLSPVWDTALAAHALLEASEPRATAAVTRALDWLRPLQVLDVRGDWTVRRPDVRPGGWAFQYANPHYPDVDDTAVVVAAMHRAARTDHSGRADPNAEATARAIEWIVGMQSANGGWGAFEPENTHLYLNNIPFADHGALLDPPTADVSARCLSMLCQTGATPDKSEPAARALQYLLAEQLPDGSWFGRWGTNYIYGTWSALCALNAAGLGPDAPPLRRAAEWLVAIQNPDGGWGEDGDSYKLEYRGYETAPSVASQTAWALLALMAAGQAAHPAVTRGIDYLLRTQQADGLWHEPRFTAVGFPRVFYLRYHGYARYFPLWALARYRNLERSGNRQVAWGL

SEQ ID NO: 204 - protein, 672 aa, Ralstonia eutropha
MSMNETAFATAVPRIAPASAGDSPAPRDAAQALDQGIGRAIDALLHQQRPDGHWVYELEADATIPAEYVLMVHYLGEAPDLELEARLARYLRRIQNPDGGWPLFHEGRSDVSASVKAYFALKMAGDDPQAAHMQRARRAVHALGGAEASNVFTRTLLALYGVMPWLAVPMMPVEIMLLPQWFPFHLSKVSYWARTVIVPLLVLNSLRPQARNPRGVGINELFVGNCHTVGLPPRAAHQHAGWYTVFRGLDALLRVAEPLVPRTLRRRAIAAAQAFVRERLNGEDGLGAIFPAMANSVMMFDVLGVPPDDPARALARQSVERLLVEHGDEAYCQPCLSPVWDTALAAHALLETGEARATAAAGRGLDWLRPLQVLDVRGDWAVRRPLVRPGGWAFQYANAYYPDVDDTAVVAAAMNRYMRAHDVPGRYDEAVARAAEWIVGMQGGDGGWGAFEPENTHLYLNNIPFADHGALLDPPTADVSARCLSMLCQIGATPGKSEPAARALRYLLAEQMPDGSWFGRWGTNYIYGTWSALCALNATGLAPEAPEMRRAVAWLEQIQNADGGWGEDGSSYRLDYRGYEPAPSVASQTAWALLALMAAGAAQHAAVARGIDYLLRTQQSGGLWHEPRFTAVGFPRVFYLRYHGYARYFPLWALARYRNLQRGGAHQVPWGL

SEQ ID NO: 205 - protein, 669 aa, Ralstonia metallidurans
MNQAATITRPQDETLTTSARRPAQPALPDPLDAGIAHVVESLLAQQQSDGHWVYELEADATIPAEYILMVHYLGETPDLVLEGKIANYLRRIQNADGGWPLFHAGASDISASVKGYFALKMAGDNPEAEHMRRARAAIHAMGGAEASNVFTRTLLALYGVMPWQAVPMMPVEIMLLPEWFPFHLSKVSYWARTVIVPLLVLNSLRPQARNPRKIGIDELFVRPCQATRLPRRAPHQSPLWVGVFRTLDAVVRMAEPLFPRGLRQRAIERAREFTVERLNGEDGLGAIFPAMVNSVLMFDVLGVPESDPNRAIARRSIDKLLVIKDDEAYCQPCLSPVWDTSLAAHALLEVGEPRTIAAAARGLDWLLPLQELELRGDWTVRRPNVRPGGWAFQYANPHYPDVDDTAVVAAAMDRVDKGDRSNRYDEAVSRACEWIVGMQSSNGGWGAFEPENTHLYLNNIPFADHGALLDPPTADVSARCLAMLCQLGQMPANSEPAARALRYLLDEQEADGSWFGRWGTNYIYGTWSALCGLNAAGIGTDAPEMKRAAQWLLSIQNEDGGWGESGDSYKLEYRGYEKAPSTASQTAWAMLGLMAAGAGDHPALVRGVEYLLRTQASHGFWDEPYFTAVGFPRVFYLRYHGYSRFFPLWALARFRNLLRDGNRAISWGL

SEQ ID NO: 206 - protein, 661 aa, Ralstonia metallidurans
MTRKTIPASELDAAIVRARDALLDRQHPDGHWCFELECDATITAEYILMMHFVDEIDTALQARMAKYLRAVQRLDGHGAWDLYFGGDLDISCSVKAYFALKAAGDPPDAPHMVRAREAILARGGAAKSNVFTRILLATFGEIPWRGTPFMPVEFVLFPRWAPIHMDKVAYWARTTMVPLLVLCSIRAAAKNPLGVHVQELFVTPPELEREYFPRKRGLQQAFLVADRVVRHLEPLIPRALRRRAIQRAVEWSEARMNGEDGFGGIFPPMVYSYEMMVLLDYPEDHPLRVECKAALKKLVVHRDDGSSYCQPCLSPVWDTAWSVMALEQAPSDARTETAIARAYDWLTDRQVLDLRGDWENNAAPSTPPGGWAFQYENPYYPDIDDSAVVLAMLHARGKRTGQPGRYEMPVARCLDWIIGLQSRNGGFGAFDANCDRDFLNAIPFADHGALLDPPTEDVSGRVLLALGITERPQDATARERCIQYLRDTQQPDGSWWGRWGTNYIYGTWSVLAGLGLAGVDRKLPMVRNGLQWLRGKQNADGGWGETNDSYARPELAGKHEDGSMAEQTAWAMLGQMAVGEGDADSVHRGAAYLLDAQNEDGFWMHPYHNAPGFPRIFHLKYHGYTAYFPLWALGRYRRLAAARASAMQTAKAESAESMTAH

SEQ ID NO: 207 - protein, 647 aa, Rhizobium sp.
MNKHSGNRTAIDPAALEMSIASATEALLAYRHADGHWAFELEADSTIPSEYILLRHYLAEPIDVVLEAKIGNYLRRTQGAHGGWPLVHDGPFDMSASVKSYFALKMIGDSVDAAHMVKAREAIRARGGAANSNVLTRFLLALYGVVSWRAVPVLPIEIVLLPIWSPFHLYKISYWARTTIVPLMVLAVLKPRAKNPKGVGIEELFLQDTKSVGMNPKAPHQSWGWFLLFRGIDGILRVIEPHLPKKLRERAIASALAFTEERLNGEDGMGAIYPSMANIVMMYDALGKDDHFPPRAIARRAIDKLLVIGEEEAYCQPCLSPVWDTALTCHALQEVGGANAVAKAKQGLDWLKPRQVLDVKGDWAVKAPNIRPGGWPFQYNNAHYPDLDDTAVVVMAMDRAQRHAGSKEYATAIARGREWIEGMQSRDGGWAAFDVNNLEYYLNNLPFADHGALLDPPTEDVTARCVSMLAQVGEFTQRSKAVAEGIAYLRRTQHAEGSWYGRWGLNYIYGTWSVLCALNAAGIDHQDPMIRKAVEWLVSIQSWDGGWGEDAISYRLDYSGYEQAPSTSSQTAWALLGLMAAGEVEHPAVARGVNYLKNAQTENGLWDEQRYTATGFPRVFYLRYHGYSKFFPLWALARYRNLRSTNV

SEQ ID NO: 208 - protein, 661 aa, Rhodopirellula baltica
MMAVVENSVSEVLDRRELRGTLDLLRGELLAQRTKDGHWTGELSASALSTATAISAMSAAVRSGKLAGADKAALLEQIQSGRRWLADQQNDDGGFGDTDRSHSNIATSYLVLAAWTLSDQVTGETTDANAISRLRNWIQLAGELDGLRRRYGKDKTFVVPILTNMAIAGLVPWKKVSALPFEAAVVPQSMYRFVGMPVVSYAVPALVAIGQVKFLEGGGCLPPWSLVRRAAIEPSMKVLRSMQPSSGGYLEATPLTAFVVMSLSASGRADHEVTQNGLRFLRDSMLPDGSWPIDTNLANWATSLATTALTMDPDDDRSWSTNELIQWQRGCQYQERHPFTGADPGGWGWTDLTGSVPDADDTPGAIISLRMQATTRPDPLCDDYSRDWPASDSSGSVSANALDTWKACDRGVDWLLGLQNRDGGWPTFCRGWGKLPFDRSSNDLTAHALRAIACLPKRESAKRSRAVQRGLRFLRKNQQADGSWLPLWFGNQDRPEEDNPIYGTSRVLVDVSPALGHDAISRGLYYLINSQNSDGGWGGGESVRETFGLPEGFISSVEETALAVEALVSWWGRIPGNEGGQAAENDIPDGSPWDASMRSALRAAILSGTRWLIDAVQRERHQVAWPIGFYFAKLWYYERLYPLVYTTAALGRVMQRDELLR

SEQ ID NO: 209 - protein, 685 aa, Rhodopseudomonas palustris
MDSILAPRADAPRNIDGALRESVQQAADWLVANQKPDGHWVGRAETNATMEAQWCLALWFLGLEDHPLRVRLGRALLDTQRPDGAWHVFYGAPNGDINATVEAYAALRSLGHRDDEEPLRKARDWILSKGGLANIRVFTRYWLALIGEWPWEKTPNILPEVIWLPTWFPFSIYNFAQWARATLMPIAVLSAHRPSRPLAPQDRLDALFPQGRDSFNYDLPARLGAGVWDVIFRKIDTILHRLQDWGARRGPHGIMRRGAIDHVLQWIIRHQDYDGSWGGIQPPWIYGLMALHTEGYAMTHPVMAKALDALNEPGWRIDIGDATFIQATNSPVWDTMLSLLAFDDAGLGERYPEQVERAVRWVLKRQVLVPGDWSVKLPDVKPGGWAFEYANNFYPDTDDTSVALMALAPFRHDPKWQAEGIEDAIQRGIDWLVAMQCKEGGWGAFDKDNDKKILAKIPFCDFGEALDPPSADVTAHIIEAFAKVGLDRNHPSIVRALDYLKREQEPEGPWFGRWGVNYVYGTGAVLPALAAIGEDMRQPYIARACDWLIARQQANGGWGESCVSYMDAKQAGEGTATASQTAWALMALIAADRPQDRDAIERGCLYLTETQRDGTWQEVHYTGTGFPGYGVGQTIKLNDPLLSKRLMQGPELSRSFMLRYDLYRHYFPMMAIGRVLRQRGDRSGH

SEQ ID NO: 210 - protein, 654 aa, Rhodopseudomonas palustris
MDSGTFNPGGERGNTLDASIDAARAALLGYRRDDGHWVFELEADCTIPAEYVLLRHYLGEPIDAALEAKIAVYLRRTQGAHGGWPLVYDGEFDMSATVKGYFALKMIGDSIDAPHMAKAREAILSRGGAVHANVFTRFLLAMFGILTWRAVPVLPVEIMLLPMWSPFHLNKISYWARTTIVPLMVLAALKPRAVNRLGVGLDELFLQDPKSIGMPARGPHQNRGLFALFGAIDAVLRVIEPLIPKKLRKHAIDRAVAFVEERLNGEDGLGAIYPPMANTVMMYKVLGYPEDHPPRAITRRGIDLLLVIGEEEAYCQPCVSPIWDTSLTCHALLEAGGAEAAQPVREGLDWLLPKQVLDLKGDWAVKAPNVRPGGWAFQYNNAHYPDLDDTAVVVMALDRARRDQPSAAYDNAIARGREWIEGMQSDDGGWAAFDVNNTEYYLNNIPFSDHGAMLDPPTEDVTARCVSMLAQLGETEQTSKAVARGVAYLRKTQLPDGSWYGRWGMNYIYGTWAVLCALNAAGVDHQDPAIRKAVAWLASIQNADGGWGEDGVSYRLDYRGYETAPSTASQTAWALLSIMAAGEVDHPAVARGIEYLKGTQTEKGLWDEQRHTATGFPRVFYLRYHGYSKFFPLWGLARYRNLRATNSKVVGVGM

SEQ ID NO: 211 - protein, 654 aa, Rhodopseudomonas palustris
MTSGTTILGAERGRTLDASIDAARAALLGYRRDDGHWVFELEADCTIPAEYVLLRHYLGEPVDAALEAKIAVYLRRTQGAHGGWPLVHDGEFDVSATVKAYFALKMIGDSIDAPHMAKAREAILARGGAIHVNVFTRFLLSMFGILTWRSVPVLPVEIMLLPMWAPFHLNKISYWARTTIVPLMVLAALKPRAVNKLDIGLDELFLQDPQSIGMPAKAPHQSWGLFTLFGSIDAVLRVIEPLIPKKLRSYAIGRAVAFIEERLNGEDGLGAIYPPMANTVMMYKVLGYGEDHPPRAITRRGIDLLLVVGEEEAYCQPCVSPIWDTSLTCHALLEAGGAEAALPVRKGLDWLIPKQVLDLKGDWAVKAPNVRPGGWAFQYNNAHYPDLDDTAVVVMALDRARRDQPSAAYDNAIARGREWIEGMQSDDGGWAAFDVNNTEYYLNNIPFSDHGALLDPPTEDVTARCVSMLAQLGETAETSSALARGVAYLRKTQLAEGSWYGRWGLNYIYGTWSVLCALNAAGVAHQDPAMRKAVAWLASIQNADGGWGEDAVSYRLDYRGYESAPSTASQTAWALLALMAAGEVDHPAVARGVEYLKGTQTEKGVWDEQRYTATGFPRVFYLRYHGYSKFFPLWALARYRNLRATNSKVVGVGM

SEQ ID NO: 212 - protein, 654 aa, Rhodopseudomonas palustris
MESGNNKQPAAAIGALDASIESATNALLGYRQPDGHWVFELEADCTIPAEYVLLRHYLGEPVDAALEAKIANYLRRVQGAHGGWPLVHDGGFDMSASVKGYFALKMIGDDIDAPHMAKAREAIRSRGGAIHSNVFTRFLLSMFGITTWRSVPVLPVEIMLLPMWSPFHLNKISYWARTTIVPLMVLAALKPRAVNRLDIGLDELFLQDPKSIKMPAKAPHQSWALFKLFAGIDAVLRTIEPLFPKRLRDHAIKLAVDFVEERLNGEDGLGAIYPPMANTVMMYKVLGFPEDHPPRAITRRGIDKLLVIGEDEAYCQPCVSPVWDTALTCHALLEVGGEAAVPPAKRGMDWLLPKQVLDLKGDWAVKRPNLRPGGWAFQYNNAHYPDLDDTAVVVMAMDRSRRATGSREYDEAIARAREWIEGMQSDDGGWAAFDVNNLEYYLNNIPFSDHGAMLDPPTEDVTARCVSMLSQLGETAASSKAVADGVEYLRRTQLPDGSWYGRWGLNYIYGTWSVLCALNAAGVDHQDPVIRKAVTWLASVQNPDGGWGEGAESYRLNYTRYEQAPTTASQTSWALLGLMAAGEVDSPVVARGVEYLKSTQTGKGLWDEQRYTATGFPRVFYLRYHGYAKFFPLWALARYRNLRSTNSKVVGVGM

SEQ ID NO: 213 - protein, 653 aa, Rhodopseudomonas palustris
MDSGSYTTGVERNALEASIDAARSALLNYRRDDGHWVFELEADCTIPAEYVLLRHYLGEPVDAELEAKIAVYLRRIQGAHGGWPLVHDGDFDMSASVKGYFALKMIGDSIDAPHMVRAREAIRSRGGAIHSNVFTRFLLTLYGVTTWRAVPVLPVEIMLLPSWSPFTLTKISYWARTTMVPLLVLCALKPQAKNPKGVGIDELFLQDPKTIGMPVKAPHQNWALFKLFGSIDAVLRVIEPVMPKGIRKRAIDKALAFIEERLNGEDGMGAIFPPMANAVMMYEALGYPEDYPPRASQRRGIDLLLVDRGDEAYCQPCVSPVWDTALASHAVLEADGHEGAKSVRPALDWLLPRQVLDVKGDWAVKAPNVRPGGWAFQYNNAHYPDLDDTAVVVMALDRARKDQPNPAYDAAIARAREWIEGMQSDDGGWGAFDINNTEYYLNNIPFSDHGAMLDPPTEDVTARCVSMLAQLGETMDSSPALARAVGYLRDTQLAEGSWYGRWGMNYIYGTWSVLCALNAAGVPHADPMIRKAVAWLESVQNRDGGWGEDAVSYRLDYRGYESAPSTASQTAWALLALMAAGEVDHPAVARGIEYLKSTQTEKGLWDEQRYTATGFPRVFYLRYHGYSKFFPLWALARYRNLQATNSKVVGVGM

SEQ ID NO: 214 - protein, 656 aa, Rhodospirillum rubrum
MDATAPLRDPGAPSAENCSVDRRELDDVIGESCRWLGERQNQDGHWVFELEADATIPAEYILLNHFLDEIDDAREARIASYLRAIQGKHGGWPLFHDGDFDMSATVKAYYALKLTGDGVDEPHMVRARQAILEHGGAERTNVFTRFTLAMFDQVPWRACPVTPVEALLLPRFAPFHWSKVSYWSRTVMTPLMILYSRRARAVNPRGIGVRELFRRDPEVIRDWLKNPTGHWIGDALIQIDKVLRVIEPAIHWAFRDRAEKWALDFIEERLNGRDGLGGIYPAIANTLMAYHTLGYAKDHPGYRIAREAVDGLCTPHAKGEYVQPCLSPVWDTCLASHAIQEAGQSAGDRAVDQSNAWLRERQVLDVVGDWKSNRGHLRPGGWAFQYNNPHYPDVDDTAVVVMALARSKEDEANREAIARAEEWIIGMQSSNGGWGAFDAENEHDFLNHVPFADHGALLDPPTVDVSARCLGMLAQLGRPKTDPVVARGLDYLWREQEADGSWFGRWGTNYIYGTWSALNAFNAVEWDMTDPRICKAVDWLKSRQRDDGGWGEDCATYWKERRSVSKASTPSQTAWAVLGLMAAGEVDSPEVERGIRYLLEAPRDGGKWEEELYNAVGFPRIFYLRYHGYSAYFPLWALARYRNLTSGNCKRTIHGM

SEQ ID NO: 215 - protein, 554 aa, Rubrobacter xylanophilus
MGRQTRNLTRREPAAEAEERGFRLLDAHRRADSSWVGELSSSALATAMSALALRLLGHPAESGPVAGGLAWLAATRNPDGGWGDAPGEPSNMNATSIAAAALARCAPRRYREEVAGGRRWVEEHGGFAALNDPRTTTLSGPGRTLWALAGLVPPERVRKLPTEMILLPRRIRRTVSTTFPAFLSLSLLHERFRPSPRWRRPLRRRAEREALAWLRRAQGPNGSYEESAFLTSLIAAALTAAGAEGGDIVRRALPFVLRSRRPDGSWPIDRDLENFDTTQAILAHHEAGRPLREAGRVREWLLDNQFRRPFFPTSSPPGGWAWAYPAGWPDTDDTACALRSLRLLGVPAGHPSIRLGLRWLYRMQNRDGSWPTFVRGSRMPFDHGCPYITSQVLSALALMGPEARRGAPLRRALAYLRRAQRPDGSLGSLWFRPHTRGTAAAVEAFSDLGLSGDPLVGRAARWLAEHQNPDGGWGDGHGAPSTAEETAWASAALLRLGGGEAARKGVRWLVEHQDPGGWKPAVIGLYYASLSYSDTFYALSYPLVALARHRRLSR

SEQ ID NO: 216 - protein, 640 aa, Saccharomonospora viridis
MTDVLTRELSPNSTRDRVRSCVSSARQYLLSLQHEEGWWKGELDTNVTMEAEDLLLRQFLGISDEQVTQETARWIRSCQREDGTWATFHGGPPDLSTTVEAYVALRLAGDAMDAAHLRKAREYILDSGGIESTRVFTRIWLALFGEWPWSRLPVLPPEMMLLPDWFPLNIYDWASWARQTVVPLTIVGSLRPTRDLGFSVRELRTGIQRRDLESPLSWAGVFHGLDSVLHRLEKLPLKPLRKVALARAEQWILDRQESDGGWGGIQPPWVYSILALHLRGYPLDHPVLRKALDGLDGFTIRHRTENGWIRKLEACQSPVWDTALAMTALLDSGTPPNDPALVRAADWILRQEIRVSGDWRVRRPALEPSGWAFEFANDHYPDTDDTAEVVLGLQRVRHPEPHRVNAAVERATAWLVGMQSSDGGWGAFDADNTRTLCEKLPFCDFGAVIDPPSADVTAHIVEMLAARGMADSESARRGVRWLLEHQEVDGSWFGRWGANHVYGTGAVVPALVACGISPQHEAVRAAVQWLVAHQNADGGWGEDLRSYVDRTWVGRGTSTPSQTAWALLALLAAGERGEVVRRGVEWLMAAQRPDGGWDEPQYTGTGFPGDFYISYHMYRIVFPLTALGRYLGRGGDVGTG

SEQ ID NO: 217 - protein, 636 aa, Saccharopolyspora erythraea
MTEEVLQRTAAPAEVLAAAREHLLSLQHERGWWKGELETNVTMDVEDLLLRRFLGILTTAETEQAARWIRSRQRADGTWAQFHGGPGDLSTTVEAYVGLKLAGDDVDSEHMAAARAWILERGGIEETRVFTRIWLALFGEWSWDDLPAMPPELVLLPPWVPLNLADWGCWARQTIVPLTVVCTLRPRRDLGVGLAELRSGRRRRKVPSPSWAGAFQVLDGALHGYQRHPLRGLREHAMRRAAEWIVARQEADGSWGGIQPPWVYSLLALHLLGYPLDHPVLRQGLAGLERFLIREETPEGTVRRLEACQSPVWDTVLSMQALRDAGLAADHPALRRAADFVLAEEIRVKGDWSVRRPDLAPGGWAFEFDNDGYPDIDDTAEVVLALNRVDHERPGAVNAAIDRGVRWMSGMQSADGGWGAFDADNTRELVNELPFCDFGAVIDPPSADVTAHVVEALCVLGRGDGEAVRRGVRWLLDHQELDGSWFGRWGANHVYGTGAAVPALVRAGLRRDHLALRRAVRWLEVHQNDDGGWGEDLRSYDDPVWVGRGRSTASQTAWALLALLAVDLHDTDAVRRGVGFLAETQRPDGTWDEPQFTGTGFPGDFYINYHLYRLVFPVTALGRYEQARREQSGGSG

SEQ ID NO: 218 - protein, 656 aa, Schizosaccharomyces japonicus
MKTDGNTTLDTTISMEELERTVKSAYEALAKDQQDDGHWIYELEADVTIPAQFILLEHTLDKIDEELEQKIANYLRRCQSREHWGWPVYYGGEFNISASVQAYFALKMTGEDINAPHMVRAREAILAHGGPEYANVFTRIQLSLFGEASWLATPFMPVEIMLLPRWMYFSIWNMSYWSRTTVAPLLIVADLKPKAINPRNVHIPELFPTPPDKVKTWIHGPFRSKWGHVFKFIDTAIRPFTRFVPSFLHKKAYKAALDFIEPRLNGVDGLGAIYPPMSYSAVMYRALGIPDDDPRAATNWEALKGLLVIKEREAYCQACVSPVWDTALSGHALMEASFGPDGINADRTEKLIDRAAHWLRAHQVLNVVGDWAINNPNLQPGGWAFQYGNDYYPDVDDTAVAAMLLHRQNLPENEEALDRARKWIIGMQSSNGGWGAFDIDNDKQILNDIPFADHGALLDPPTADVSARCISLLAELGHPEDRPVIERGIKYLRKEQEEDGSWFGRWGTNYIYGAWSVLCAFNASGVPHDDPSVLKCVNFLKSVQREDGGWGESCETYEGSAHGVYTESLPSQTAWAVLGLMASGRRTDPAVKRGIVWLIQHQQDNGEWAEEPFNAVGFPRMFYLHYLGYKQFFPLLALARYRHMEKSGTNNVSFAF

SEQ ID NO: 219 - protein, 617 aa, Sphaerobacter thermophilus
MDPALSRAVDWLLEHQDPAGWWCGEFETNVTITAEHILLLRFLGLDPSPLRDAVTRYLLGQQREDGSWALYYEGPADLSTSIEAYAALKVLGLDPTSEPMRRALQVIHDLGGVAQARVFTRIWLAMFGQYPWDGVPSMPPELIWLPPSAPFNLYDFACWARATITPLLIILARRPVRPLGCDLGELVLPGSEHLLTRVPGSGPFWWGDKVLKRYDHLVRHPGRDRACQRIVEWIIARQEADGSWGGIQSAWVMSLIALHLEGLPLDHPVMRAGLAGFDRVALEDERGWRLQASTSPVWDTAWAVLALRRAGLPREHPRLALAVDWLLQEQIPGGGDWQVRTGTIPGGGWAFEFDNDHYPDIDDTAVVVLALLEAGHEDRVRNAVERAARWILAMRSTDGGWGAFDRDNAREVIHRLPIADFGTLIDPPSEDVTAHVLEMLARLSFPSTDPVVARGLEFLQQTQRPDGAWFGRWGVNYIYGTWCAVSALTAFADTDATARAMVPRAVAWLLDRQNADGGWGETCGSYEDPNLAGVGRSTPSQTAWAVLALQAAGLGQHPACRRGLDFLRERQVGGTWEEREHTGTGFPGDFFINYHLYRHVFPTMALAGAATGMDSPR

SEQ ID NO: 220 - protein, 583 aa, Streptomyces albus
FLGIRDEATTRSAALFIRGEQREDGTWATFHGGPPDLSTTVEAYVALRLAGDSPDAPHMTRAAHWVRSQGGIAEARVFTRIWLALFGWWPWDRLPELPPELIFLPPWAPLNIYDFGCWARQTIVPLTVVSAKRPVRPAPFPLDELHTDPADPAPRARFAPLASWNGAFQRLDRALHAYRKVAPRALRRAAMATAGRWIVERQENDGCWGGIQPPAVYSMIALHLLGYDLGHPVMRAGLESLDRFTLTREDGSRMVEACQSPVWDTCLATIALADAGVPADHPQLVRAADWMLDEQIERPGDWSVRRPHLAPGGWAFEFHNDNYPDIDDTAEVVLALRRVRHPDTARMERAISLGVRWNLGMQSKNGAWGAFDVDNTSSLPNRLPFCDFGEVVDPPSADVTAHVVEMLAAEGLAADPRTRRAVDWLLAEQEPSGAWFGRWGVNYLYGTGSAVPALVDAGLPTTHPAIRRAVAWLESVQNDDGGWGEDLRSYREQGRMARGASTASQTGWALMALLAAGERESRAARRGVTFLAETQHEDGSWEEPYYTGTGFPWDFSINYHLYRQVFPLTALGRYTRGAAPEGA

SEQ ID NO: 221 - protein, 666 aa, Streptomyces avermitilis
MTATTDGSTGALPPRAASASEPHDTIPQAAGSVGIQDAAARATQRATDFLLSRQDAEGWWKGDLETNVTMDAEDLLLRQFLGIQDEKTTRAAGLFIRGEQRADGTWATFYGGPGDLSATIEAYVALRLAGDGPDEPHMAKASAWIRERGGIASARVFTRIWLALFGWWKWDDLPELPPELIYFPKWMPLNIYDFGCWARQTIVPLTVVSAKRPVRPAPFPLDELHADANDPNPAKPLAPMVSWDGLFQRLDVALHTYRKVAPRRLRKAAMNTAARWIIERQENDGCWGGIQPPAVYSVIALYLLGYDLEHPVMREGLASLDRFAVWRDDGARMIEACQSPVWDTCLATIALADAGVPADHPQLVRAADWMLGEEIVRPGDWAVKRPQLPPGGWAFEFHNDNYPDIDDTAEVVLALRRVKHHDPERLDNAIRRGVRWNLGMQSKDGGWGAFDVDNTSPFPNRLPFCDFGEVIDPPSADVTAHVVEMLAFEGLSHDPRTRRGIQWLLSAQEANGSWFGRWGVNYVYGTGSVVPALVAAGLPASHPAIRRAVTWLETVQNDDGGWGEDLRSYPEAAEWSGKGASTASQTGWALLALLAAGERESKAVERGIEWLAQTQRPDGSWDEPYFTGTGFPWDFSINYHLYRQVFPLTALGRYVNGEPLVEVKGG

SEQ ID NO: 222 - protein, 639 aa, Acaryochloris marina
MAVRDRVNPKTLEAAIAASQSYLLTQQDETGYWWAELESNVSITSEVVLLHKIWGTDRSRPLEKVETYLRSQQRDHGGWELYFDDGGEISVSVEAYMALKLLGVPMEDPAMVRARQFILEHGGISRTRVFTKLHLALIGCYEWRGIPSLPPWVMLLPEQFPFTIYEMSSWARGSTVPLLIVMDREPVYAVEAGFNLDELYVEGRHRAQFDLPLSNEWTDAFIYLDGLFKFAESTNLVPFREEGIRAAERWILERQEATGDWGGIIPAMLNSLLGLKALDYDVHDPIIERGMAALDAFALETEDQYWIQPCISPVWDTALVVRGLAESGLAPDHPALVKAGEWLLNKQILDYGDWSVKNPGGLPGGWAFEFDNRFYPDVDDTAVVVMALNEVQLPDEQAKDAAIARAVNWIATMQCRPGGWAAFDINNDQDWLNALPYGDLKAMIDPNTADVTARVLEMIGRCHQTTGKNSVDRALRYLRTEQEPEGCWFGRWGVNYIYGTSGVLAALALIDPQGWQSQIQQAAAWLVSCQNTDGGWGETCASYDNPKLKGQGPSTASQTAWAIMGLLSAGEATSVYAEAAIERGVNYLTTTQKMDGTWDEDYFTGTGFPGHFYLKYHLYQQHFPLTALGRYQAMLQQKS

SEQ ID NO: 223 - protein, 666 aa, Streptomyces filamentosus
MTATTDGSTGAANITGAPADDPTDTRTAANDVTDIARRAAERSVEHLLGRQDEQGWWKGDLATNVTMDAEDLLLRQFLGIQDPATTRAAALFIRGEQLGDGTWNTFYGGPGDLSATIEAYVALRLAGDRPDEPHMARASGWIRDQGGIAAARVFTRIWLALFGWWKWDDLPELPPELMFFPKWVPLNIYDFGCWARQTIVPLTIVSAKRPVRPAPFALDELHTDPDHPNPPRKLAPPTSWDGLFQRLDKGLHLYHKVAPRPLRRIAMNVAARWIIERQENDGCWGGIQPPAVYSVIALHLLGYDLDHPVMKAGLASLDRFAVHREDGARMIEACQSPVWDTCLATIALADAGLRPDHPALVKAADWMLAEEITRPGDWSVRKPELAPGGWAFEFHNDNYPDIDDTAEVVLALRRVRHPDPARLEAAIARGVRWNLGMQSRNGAWGAFDADNTSPFPNRLPFCDFGEVIDPPSADVTGHVVEMLAVEGLANHPRTREGIEWLLAEQEACGAWFGRWGVNYVYGTGSVVPALITAGLPAGHPAIRRAVDWLESVQNDDGGWGEDLRSYQEEKWIGHGESTASQTAWALLALLAAGRRDTASVTRGVTWLTEAQQADGSWDEPYFTGTGFPWDFSINYHLYRQVFPLTALGRYVHGDPFADRTDAAEGV

SEQ ID NO: 224 - protein, 670 aa, Streptomyces flavogriseus
MTATTDGSTGAANLRAAAASDPTESTSAAPDMMAVARHAAERSVEHLLGRQDEQGWWKGDLATNVTMDAEDLLLRQFLGIQDPETVKAAARFIRGEQLGDGTWNTFYEGPPDLSATVEAYVALRLAGDRPDDPHMIRAAGWVREQGGIAESRVFTRIWLALFGWWKWDDLPELPPELMFFPKWVPLNIYDFGCWARQTIVPLTIVSAKRPVRPAPFALDELHTDPACPNPSRPTAPAASWDGVFQRLDKALHLYHKVAPRRLRRIAMNEAARWIIERQENDGCWGGIQPPAVYSVIALHLLGYDLDHPVMRAGLESLDRFAVWREDGARMIEACQSPVWDTCLATIALADAGVSPDHPALVRAADWMLGEEIVRPGDWAVRKPGLAPGGWAFEFHNVNYPDIDDTAEVALALRRVRHPDPARVDAAIERGVRWNLGMQSRNGAWGAFDADNTSPFPNRLPFCDFGEVIDPPSADVTGHVVEMLAVEGRAHDPRTRRGVEWLLAEQEASGAWFGRWGVNYIYGTGSVVPALIAAGLPAAHPSVRRAVDWLRSVQNDDGGWGEDLRSYREEKWIGHGSSTASQTGWALLALLAAGERETRSVERGVAWLAATQQADGSWDEPHFTGTGFPWDFSINYHLYRQVFPLTALGRYVYGDPFATATAIGAGTGKGA

SEQ ID NO: 225 - protein, 686 aa, Streptomyces ghanaensis
MTATTDGSTGAALPPRVTAASDTDTDIPVAAGVPDIAARAMRRATDFLLSRQSDQGWWKGDLETNVTMDAEDLLLRQFLGIRDEGTTRAAALFIRGEQREDGTWATFHGGPGDLSATIEAYVALRLAGDPPDAPHLARASAWIREQGGIAASRVFTRIWLALFGWWKWEDLPELPPELIWFPAWVPLNIYDFGCWARQTIVPLTIVSAERPVRPAPFPLDELHTDPARPNPPRALAPVTGWDGAFQRLDKALHVLRGAVPRRLRRAAMNTAARWIIERQENDGCWGGIQPPAVYSIIALHLLGYDLNHPVMRAGLESLDRFAVWREDGARMIEACQSPVWDTCLATIALADAGLPADHPQLVKAADWMLGEQIVRPGDWSVRRPHLPPGGWAFEFHNDNYPDIDDTAEVVLALRRVAHHDPERVDNAIGRGVRWNLGMQSRNGAWGAFDVDNTSPFPNRLPFCDFGEVIDPPSADVTAHVVEMLAAEGLAHDPRTRRGVQWLLAEQEPNGSWFGRWGVNYLYGTGSVVPALTAAGISGSHPAIRRAVAWLESVQNDDGGWGEDLRSYRDARGWSGRGASTASQTAWALMALLAAGERESRAVERGVEWLAATQHEDGSWDEPYFTGTGFPWDFSINYHLYRQVFPLTALGRYVNGEPLAGKPRAAGAATAREDTGQEQSLAEAKGS

SEQ ID NO: 226 - protein, 680 aa, Streptomyces griseoflavus
MTATTDGSTGAALPPRVTAASENDTDIPEAAGVPDIAAHAMRRATDFLLSRQDDQGWWKGDLETNVTMDAEDLLLRQFLGIRDEDTTRAAALFIRGEQREDGTWATFHGGPGELSTTIEAYVALRLAGDPPEAPHMARASAWIRERGGIAAARVFTRIWLALFGWWKWEDLPELPPELIWFPSWVPLNIYDFGCWARQTIVPLTIVSAKRPVRPAPFPLDELHTDPRRPRPPRPHAPPNTWDGAFQRLDRALHALRRAVPRRVRQAAMNAAARWIIERQENDGCWGGIQPPAVYSVIALHLLGYDLRHPVMRAGLESLDRFAVWREDGARMIEACQSPVWDTCLAAIALADAGLPADHPSLVKAADWMLGEQIVRPGDWSVRRPHLPPGGWAFEFHNDNYPDIDDTAEVVLALRRVRHHDPERMDSAIGRGVRWSLGMQSKNGAWGAFDVDNTSPFPNRLPFCDFGEVIDPPSADVTAHVVEMLAVEGLAHDPRTRRGIQWLLAEQEPDGSWFGRWGVNYLYGTGSVVPALAAAGIPGSHPAIRRAVAWLEKVQNDDGGWGEDLRSYRHVREWSGRGASTASQTAWALMALLAAGERDSGAVERGVAWLAATQREDGSWDEPYFTGTGFPWDFSINYHLYRQVFPLTALGRYVHGEPFSKKQTAARNGSAQPLAGVKGSR

SEQ ID NO: 227 - protein, 666 aa, Streptomyces griseus
MTATTDGSTGAANPSEATAHDPTDTTTAADDLTVAARRAAERSVEHLLGRQDEQGWWKGDLATNVTMDAEDLLLRQFLSIQDPETTRAAALFIRGEQLGDGTWNTFYGGPGDLSATIEAYVALRLAGDRPDEPHMARAAGWIRDQGGIAAARVFTRIWLALFGWWKWDDLPELPPELMFFPKWVPLNIYDFGCWARQTIVPLTIVSAKRPVRPAPFALDELHTDPDHPNPPRKLAPPTSWDGLFQRLDKGLHLYHKVAPRPLRRVAMNLAARWIIERQENDGCWGGIQPPAVYSVIALHLLGYDLDHPVMKAGLASLDRFAVRREDGARMIEACQSPVWDTCLATIALADAGLRPDHPALVKAADWMLAEEITRPGDWSVRKPELAPGGWAFEFHNDNYPDIDDTAEVVLALRRVRHPDPARLQAAIDRGVRWNLGMQSRNGAWGAFDADNTSPFPNRLPFCDFGEVIDPPSADVTGHVVEMLAVEGLASHPRTREGIEWLLAEQEACGAWFGRWGVNYVYGTGSVVPALITAGLPAGHPAIRRAVAWLESVQNDDGGWGEDLRSYQEEKWIGHGESTASQTAWALLALLAAGRRDTRPVARGVTWLTEAQQADGSWDEPYFTGTGFPWDFSINYHLYRQVFPLTALGRYVHGDPFADRAMAAEGA

SEQ ID NO: 228 - protein, 630 aa, Streptomyces hygroscopicus
MLARRATDRAVRHLLSRQDEQGWWKGDLETNVTMDAEDLMLRHFLGIQNPDVLDAAGRYIRSQQAADGTWATFHGGPPELSATVEAYVALRLAGDPPDAPHMAAASAWVRNNGGVASSRVFTRIWLALFGWWRWEDLPELPPEIIYFPPWLPLNLYDFGCWARQTIVPLTVVSAKRPVRPAPFSLDELHADPRRPNPPRPAAPLASWDGAFQRLDRALHLYRKVALRPLRRAALRSCARWIVERQENDGCWGGIQPPAVYSVIALHLLGYDLDHPVMRAGLESLDRFAVWREDGSRMIEACQSPVWDTCLAVIALADAGLAPDHPALVKSADWMLAEEIDRPGDWSVKRPRLAPGGWAFEFDNDNYPDIDDTAEVILALRRVDHPRPERIAAAVRRGVRWTLGMQSRNGAWGAFDVDNTSPLPNRLPFCDFGEVIDPPSADVTAHVVEMLAHEGGARDPRTRRAVGWLLAEQEPSGAWFGRWGTNYVYGTGSVVPALVAAGLPATHPAIRRAVRWLESVQNEDGGWGEDQRSYPDPEWIGHGASTASQTAWALLALLAAGERESKAVERGVGWLAATQDQDGSWDEPYFTGTGFPWDFSINYHLYRLVFPLTALGRYVSGEATGARPRRT

SEQ ID NO: 229 - protein, 680 aa, Streptomyces lividans
MTATTDGSTGASLRPLAASASDTDITIPAAAAGVPEAAARATRRATDFLLAKQDAEGWWKGDLETNVTMDAEDLLLRQFLGIQDEETTRAAALFIRGEQREDGTWATFYGGPGELSTTIEAYVALRLAGDSPEAPHMARAAEWIRSRGGIASARVFTRIWLALFGWWKWDDLPELPPELIYFPTWVPLNIYDFGCWARQTIVPLTIVSAKRPVRPAPFPLDELHTDPARPNPPRPLAPVASWDGAFQRIDKALHAYRKVAPRRLRRAAMNSAARWIIERQENDGCWGGIQPPAVYSVIALYLLGYDLEHPVMRAGLESLDRFAVWREDGARMIEACQSPVWDTCLATIALADAGVPEDHPQLVKASDWMLGEQIVRPGDWSVKRPGLPPGGWAFEFHNDNYPDIDDTAEVVLALRRVRHHDPERVEKAIGRGVRWNLGMQSKNGAWGAFDVDNTSAFPNRLPFCDFGEVIDPPSADVTAHVVEMLAVEGLAHDPRTRRGIQWLLDAQEADGSWFGRWGVNYVYGTGSVIPALTAAGLPTSHPAIRRAVRWLESVQNEDGGWGEDLRSYRYVREWSGRGASTASQTGWALMALLAAGERDSKAVERGVAWLAATQREDGSWDEPYFTGTGFPWDFSINYNLYRQVFPLTALGRYVHGEPFAKKSRAADAPAEAAPAEVKGS

SEQ ID NO: 230 - protein, 674 aa, Streptomyces peucetius
MTATTDGSSGPLRGGAATAGETTSTSAARTTEPGTDLREAAARAAERAVEHLLARQDAEGWWKGDLETNVTMDAEDLLLRQFLGIQDPATVGASARFIRGQQRDDGTWATFYGGPGELSTTVEAYVALRLAGDRPDDPHMQRAASWVRSRGGIAASRVFTRIWLALFGWWKWEDLPELPPELIFLPKWFPLNIYDFGCWARQTIVPLTVVSAKRPVRPAPFALDELHTDPALPNPGKRLAPAASWDGFFQRADKALHAYHKVAPRRLRRAAMNAAARWIIERQENDGCWGGIQPPAVYSVIALHLLGYDLEHPVMRAGLESLDRFAVHHEEEGLPVRMIEACQSPVWDTCLATIALADAGLPADHPALVKAADWMLSEQIVRPGDWSVRRPGLGPGGWAFEFHNDNYPDIDDTAEVVLALRRVKHPDPERVDAAVARGTRWNLGMQSRDGAWGAFDADNTSPFPNRLPFCDFGEVIDPPSADVTAHVVEILAHEGMAHDPRTRRGVRWLLAHQEANGAWFGRWGVNYVYGTGAVVPALTAAGLPGSHPAIRRAVAWLESVQNEDGGWGEDLRSYREEKSIGRGVSTASQTGWALLALLAAGERESKAVERGVAHLAQTQAPDGSWDEPYFTGTGFPWDFSINYHLYRQVFPLTALGRYVHGEKLPGRAGAREGR

SEQ ID NO: 231 - protein, 674 aa, Streptomyces pristinaespiralis
MTATTDGSSGPVRAGAATAGDTTTTTAARTTAPGTDVREAAGRAAERAVEHLLARQDAQGWWKGDLETNVTMDAEDLLLRQFLGIQDAATVEASARFIRGQQRDDGTWATFYGGPGELSTTIEAYVALRLAGDRPDDPHMQRAASWVRSRGGIAAARVFTRIWLALFGWWKWDDLPELPPELILLPKWVPLNIYDFGCWARQTIVPLTVVSAKRPVRPAPFALDELHTDPAMPNPQKRFAPAASWDGFFQRADKALHLYHKVAPRRLRRAAMNAAARWIIERQENDGCWGGIQPPAVYSVIALHLLGYDLEHPVMRAGLESLDRFAVHREEEGLPVRMIEACQSPVWDTCLATIALADAGLPADHPALVKAADWMLSEQIVRPGDWAVRRPGLGPGGWAFEFHNDNYPDIDDTAEVILALRRVKHPDPERVEAAVARGTRWNLGMQSLNGAWGAFDADNTSPFPNRLPFCDFGEVIDPPSADVTAHVVEMLAHEGMAEDPRTRRGVRWLLREQEANGAWFGRWGVNYVYGTGAVVPALIAAGLPASHPSVRRAVTWLESVQNEDGGWGEDLRSYREEQSIGRGASTASQTGWALLALLSAGERDGRAVERGVAWLARTQRPDGSWDEPYFTGTGFPWDFSINYHLYRQVFPLTALGRFLHGEKPVGRAAAREGG

SEQ ID NO: 232 - protein, 664 aa, Streptomyces scabiei
MTATTDGSTGALPPRAPSASDTDHGTPVAAGVQEAALHAVGRATDFLLSRQDAQGWWKGDLETNVTMDAEDLLLRQFLGIRDDATTRAAALFIRGEQRPDGTWATFYGGPPDLSATVEAYVALRLAGDDPAAPHMAKASAWIRARGGIAAARVFTRIWLALFGWWKWDDLPEMPPEIVYFPTWMPLNIYDFGCWARQTIVPLTVVSAKRPVRPAPFPLDELHTDPGRPNPPRPLDRLGSWEGAFQRLDRALHGYHKVALKRLRRAAMNRAARWIVERQENDGCWGGIQPPAVYSVIALHLLGYDLGHPVMRAGLESLDRFAVWREDGARMIEACQSPVWDTCLATIALADAGLPPDHPQLVKAADWMLGEEIVRPGDWSVKRPQLPPGGWAFEFHNDNYPDIDDTAEVVLALRRVRHPDPERVERAVRRGVRWTLGMQSGNGAWAAFDADNTSPFPNRLPFCDFGEVIDPPSADVTAHVVEMLAAEGLSHDPRTRRGIEWLLAEQEPGGAWFGRWGVNYVYGTGSVVPALVTAGLPAAHPAIRRAVAWLETVQNDDGGWGEDLRSYPDPAEWGGKGASTASQTAWALLALLAAGERDGKATERGVAWLARTQREDGSWDEPYFTGTGFPWDFSINYHLYRQVFPLTALGRYVHGEPAVLKPGTR

SEQ ID NO: 233 - protein, 684 aa, Streptomyces sp.
MRRRRSPRGPGAGPEADYGPARASAPDRLRGDAARGDAARRVQDATARAIRNLLGRQDPAGWWKGDLETNVTMDAEDLLLRQFLGIRDEAVTQAAALFIRREQREDGTWATFHGGPPELSATIEAYVALRLAGDAPDAPHMATASAWIRAHGGLAAARVFTRIWLALFGWWDWENLPELPPELVLLPPWVPLNIYDFGCWARQTIVPLTVVSAMRPVRPAPFALDELHTDARVPVPPRRMAPPTTWNGAFQWMDRALHVYRRFAPRRLREAAMASAGRWIIERQENDGCWGGIQPPAVYSVIALHLLGYDLGHPVMRAGLESLDRFAVWREDGSRMIEACQSPVWDTCLAAIALADAGVRPDHPALVKAADWMLGEEIVRTGDWAVRRPGLAPGGWAFEFHNDTYPDIDDTAEVVLALRRIRHPDPARVEAAIARGVSWNLGMQSRGGAWGAFDADNTSPFPNRLPFCDFGEVIDPPSADVTAHVVEMLAAEGRAADPRTRRGIAWLLAEQEPEGPWFGRWGTNYVYGTGSVVPALTAAGLSPGHPAIRRAVLWLESVQNPDGGWGEDQRSYQDRAWAGKGESTPSQTAWALMALLSAGERDAKTVERGIAYLVETQLADGGWDEPHFTGTGFPWDFSINYHLYRHVFPLTALGRYLYGEPFGHDGRHIGAHLGDRTGVPAEGV

SEQ ID NO: 234 - protein, 665 aa, Streptomyces sp.
MHEGEAMTATTDGSTGAATPPATTASAPLHLSPEARETHEATARATRRAVDFLLARQSDEGWWKGDLATNVTMDAEDLLLRQFLGIRDEATTRAAALFIRGEQQEDGTWNTFYGGPGDLSATIEGYVALRLAGDSPEAPHMRKASAFVRAQGGVARARVFTRIWLALFGWWKWEDLPEMPPELMFFPKWAPLNIYDFGCWARQTIVPLTVVCAQRPVRPAPFALEELHTDPADPDPAQPAPPVVSWDNVFHKLDKLLHGYRRIAPRRVREAAMRAAATWIVERQENDGCWGGIQPPAVYSIMALNLLGYDLDHPVLRAGLASLDRFAVWREDGARMIEACQSPVWDTCLATVALADAGVPADHPQMIKAADWMLAEQIVRPGDWVVRRPDLPPGGWAFEFHNDNYPDIDDTAEVVLALRRVAHPDATRVDKAVRRAVDWNVGMQSKNGAWGAFDADNTSPFPNRLPFSDFGEVIDPPSADVTAHVVEMLAEEGLAHHPRTRRGIEWLLKNQEGNGSWFGRWGVNYVYGTGAVVPALVAAGLPASHPAIRRSVSWLGQVQNEDGGWGEDLRSYQDSAWHGRGHSTASQTAWALLALLAAGERETEQVRRGIAYLVETQTEDGTWDEPWFTGTGFPWDFTINYHLYRQVFPVTALGRYLNGTGPGEN

SEQ ID NO: 235 - protein, 636 aa, Streptomyces sp. AA4
MTQTVPRTAASAPAARTAADTVAAAVQFLRREQDRAGWWKGELATNVTMDAEDLLLRHFLGILTPQIAEESARWIRSQQRADGTWANFPDGPADLSTTVEAWVALRLAGDPADAPWLATAAEWIREHGGIEATRVFTRIWLAMVGQWSWDDLPSLPPELIFLPSWFPLNVYDFACWARQTIVPLTIVGTLRPARKLPFDVAELRTGKRPPKPRAPWTWDGVFQNLDTALHAYAKLPLNPVRKLALKQAAEWILARQEADGSWGGIQPPWVYSILALHLLGYSLDHPALKAGIAGLDGFTIREKTDQGWVRRLEACQSPVWDTALAMTALLDAGVSPGDESLVRAAEWMLGEEIRVPGDWAVRRPSLKPGGFAFEFANDGYPDTDDTAEVVLALRRMGKPDHLRIREAVDRSVAWLEGMQSSDGGWGAFDADNTQVLTTRLPFCDFGAVIDPPSADVTAHVVEMLAAEGKADTRECRRGIRWLWDNQEADGSWFGRWGANYVYGTGAVVPALVAAGVPGTDPRIRRAVRWLAEHQNDDGGWGEDLRSYDDRSWAGRGDSTPSQTAWALLALLAAGERESTVVARGVEWLCERQRPDGGWDEDKHTGTGFPGDFYLSYHLYRVVFPLSALGRYVRGGS

SEQ ID NO: 236 - protein, 676 aa, Streptomyces sp. C
MTATTDGGGAITGGADPRHDSTAAPAAAAAGPSGGGTGLPEGVREAVDRATAELLARQDPAGWWKGDLQTNVTMDAEDLLLRQFLGIRDEAVTRAAALFIRGEQQGDGTWATFHGGPPELSATIEAYVALRLAGDPPDAPHMTRASAWIRAHGGIAAARVFTRIWLALFGWWSWDRLPELPPELVFLPPWVPLNIYDFGCWARQTIVPLTVVSALRPVRSAPFALDELHTDARDPVPAKPLPPLASWDGAFQRMDKALHLYRRVAPRRLRKAAMAAAGRWIVERQENDGCWGGIQPPAVYSVIALHLLGYDLGHPVMRAGLESLDRFAVWREDGARMVEACQSPVWDTCLAAIALADAGLPPDHPALVRAADWMLGEEIRRPGDWAVRRPGLAPGGWAFEFHNDNYPDIDDTAEVVLALRRIRHPQPGGVEAAIARGVSWTLGMQSKNGAWGAFDADNTSPFPNRLPFCDFGEVIDPPSADVTAHVVEMLAAEGRAADPRARRGIAWLLAEQEPDGPWFGRWGTNYVYGTGSVVPALTAAGIAPSHPAVRRAVRWLESVQNEDGGWGEDQRSYRDRSWAGKGASTASQTAWALMALLSAGERDGDAVARGLAYLVETQRPDGTWDEPYFTGTGFPWDFSINYHLYRQVFPLTALGRYLHGEPFGPERRNVPPAGES

SEQ ID NO: 237 - protein, 684 aa, Streptomyces sp. Mg1; identical to SEQ ID NO: 233

SEQ ID NO: 238 - protein, 665 aa, Streptomyces sp. SPB74; identical to SEQ ID NO: 234

SEQ ID NO: 239 - protein, 606 aa, Streptomyces sp. SPB78
MDFLLDRQSDEGWWKGDLATNVTMDAEDLLLRQFLGIRDEATTQAAALFIRGEQQEDGTWNTFYGGPGDLSATIEGYVALRLAGDSPEAPHMRKASAFVRARGGVARARVFTRIWLALFGWWKWEDLPEMPPELMFFPKWAPLNIYDFGCWARQTIVPLTVVCAQRPVRPAPFALEELHTDPADPNPAQPAPPVASWDNVFHKLDKMLHGYRKVAPRRVREAAMRAAATWIVERQENDGCWGGIQPPAVYSIIALHLLGYDLDHPVLRAGLESLDRFAVWREDGARMIEACQSPVWDTCLATVALADAGVPADHPQMIRAADWMLAEQIVRPGDWVVRRPDLPPGGWAFEFHNDNYPDIDDTAEVVLALRRVAHPDATRVDKAVRRAVDWNAGMQSKNGAWGAFDADNTSPFPNRLPFSDFGEVIDPPSADVTAHVVEMLAEEGLAHHPRTRRGIEWLLENQEANGSWFGRWGVNYVYGTGAVVPALVAAGIPAAHPAIRRSVSWLGQVQNEDGGWGEDLRSYQDTAWHGRGHSTASQTAWALLALLAAGERDSEQVRRGIAYLVETQTEDGTWDEPWFTGTGFPWDFTINYHLYRQVFPVTALGR

SEQ ID NO: 240 - protein, 669 aa, Streptomyces sviceus
MHEGEAMTATTDGSTGALPPRAAAASETHLDTPVAAGIQEAAVRAVQRATEHLLARQDAEGWWKGDLETNVTMDAEDLLLRQFLGIRDESTTRAAAKFIRGEQREDGTWAGFYGGPGELSTTVEAYVALRLDGDAPDAPHMAKASAWIRAQGGIAAARVFTRIWLALFGWWKWEDLPELPPELIYFPKWAPLNIYDFGCWARQTIVPLTIVSAKRPVRPAPFPLDELHADPADPNPAKPLAPVASWDGAFQRLDKAMHQLRKVAPRRLRRAAMNSAARWIIERQENDGCWGGIQPPAVYSVIALHLLGYDLQHPVMRAGLESLDRFAIWREDGSRMIEACQSPVWDTCLATIALVDAGVPADHPQLVKAADWMLGEEIVRPGDWSVKRPQLPPGGWAFEFHNDNYPDIDDTAEVVLALRRVRHHDPDRVENAIGRGVRWNLGMQSKNGAWGAFDVDNTSPFPNRLPFCDFGEVIDPPSADVTAHVVEMLAVEGLSHDPRTRRGIEWLLAEQEPDGSWFGRWGVNYIYGTGSVVPALTAAGLPASHPAIRRAVAWLEKVQNDDGGWGEDLRSYKYVKEWSGRGASTASQTAWALMALLAAGERDSKAVERGVEWLASTQRADGSWDEPYFTGTGFPWDFSINYHLYRQVFPLTALGRYVHGEPFSRTEAL

SEQ ID NO: 241 - protein, 664 aa, Streptomyces viridochromogenes
MTATTDGSTGALPPRADAASEHDIETPEAAGVREAAVRAARRATDFLLSRQDAQGWWKGDLETNVTMDAEDLMLRQFLGVLDEKTAQAAALFIRGEQREDGTWASFYGGPGELSTTIEAYVALRLAGDAPDSPHLAKASAWIREQGGIAAARVFTRIWLALFGWWKWEDLPELPPELIWFPKWVPLNIYDFGCWARQTIVPLTIVSAKRPVRPAPFPLDELHTDPARPNPPRPLAPAFSWDGAFQRMDKGLHALRKVAPRGLRRAAMNAAARWIIERQENDGCWGGIQPPAVYSIIALHLLGYDLQHPVMREGLASLDRFAVWREDGARMVEACQSPVWDTCLAAIALVDAGLPADHPQLVKAADWMLGEEIVRPGDWSVRRPGLPPGGWAFEFHNDNYPDIDDTAEVILALRRITHHDPVRVDKAVGRGVRWTLGMQSKNGAWAAFDVDNTSPFPNRLPFCDFGEVIDPPSADVTAHVIEMLAVEGLAHDPRTRRGIEWLLAEQEPDGSWFGRWGVNYVYGTGSVVPALVAAGLPGAHPAIRRAVSWLESVQNDDGGWGEDLRSYKYVKEWSGRGASTASQTAWALMALLAAGERDSKAVERGVEWLAATQREDGSWDEPYFTGTGFPWDFSINYHLYRQVFPLTALGRYVHGEPFADRLKGS

SEQ ID NO: 242 - protein, 653 aa, Synechococcus sp.
MSISALQTDRLSQTLTQSVVAAQQHLLSIQNPEGYWWANLESNASITAEVVLLHKIWGTLDSQPLAKLENYLRAQQKTHGGWELYWNDGGELSTSVEAYMGLRLLGVPASDPALVKAKQFILHRGGVSKTRIFTKFHLALIGCYRWQGLPSLPAWVMQLESPFPFSIYELSSWARGSTVPLLIVFDKKPVYPLQPSPTLDELFTESAENVRWELEEKGDWSDAFLWLDKAFKLAESVDLVPFREESIRKAEKWVLERQEPSGDWGGIIPAMLNSMLALRALGYSVSDPVVRRGFQAIDNFMVESETECWAQPCISPVWDTGLAVRSLTDSGLSPNHPALVKAGEWLLDKQILSYGDWSVKNPQGQPGGWAFEFENSFYPDVDDTAVVAMALQDITLPNEPLKRRAIARAVRWIATMQCKTGGWAAFDINNDQDWLNDIPYGDLRAMIDPSTADITGRVLEMHGRFAADLDLANSYAADLSPYRLSRGLNYLIKEQELDGSWFGRWGVNYIYGTGQALSALALIAPERCRIQIERGIAWFVSVQNADGGWGETCESYKDKSLKGKGISTASQTAWALLGLLDVSFCLDPAAKIAVDRGIQYLVSTQSEGTWQEESFTGTGFPQHFYLRYRLYCHYFPLMALGRYQRVINSSAGI

SEQ ID NO: 243 - protein, 653 aa, Synechococcus sp. PCC 7335; identical to SEQ ID NO: 242

SEQ ID NO: 244 - protein, 647 aa, Synechocystis sp.
MVIAASPSVPCPSTEQVRQAIAASRDFLLSEQYADGYWWSELESNVTITAEVVILHKIWGTAAQRPLEKAKNYLLQQQRDHGGWELYYGDGGELSTSVEAYTALRILGVPATDPALVKAKNFIVGRGGISKSRIFTKMHLALIGCYDWRGTPSIPPWVMLLPNNFFFNIYEMSSWARSSTVPLMIVCDQKPVYDIAQGLRVDELYAEGMENVQYKLPESGTIWDIFIGLDSLFKLQEQAKVVPFREQGLALAEKWILERQEVSGDWGGIIPAMLNSLLALKVLGYDVNDLYVQRGLAAIDNFAVETEDSYAIQACVSPVWDTAWVVRALAEADLGKDHPALVKAGQWLLDKQILTYGDWQIKNPHGEPGAWAFEFDNNFYPDIDDTCVVMMALQGITLPDEERKQGAINKALQWIATMQCKTGGWAAFDIDNDQDWLNQLPYGDLKAMIDPSTADITARVVEMLGACGLTMDSPRVERGLTYLLQEQEQDGSWFGRWGVNYLYGTSGALSALAIYDAQRFAPQIKTAIAWLLSCQNADGGWGETCESYKNKQLKGQGNSTASQTAWALIGLLDALKYLPSLGQDAKLTTAIEGGVAFLVQGQTPKGTWEEAEYTGTGFPCHFYIRYHYYRQYFPLIALARYSHLQAS

SEQ ID NO: 245 - protein, 688 aa, Syntrophobacter fumaroxidans
MNPIRGKRGSAADFLEEEYQWENLADHGESGRTPGGGHPAALKEYEAGSATEHTGHHCVHHLGVRNSWLRKIEKAIDNACGQLFKTQYEDGYWWSELESNVTITSEYIMLLYLLEVSRPEQQKSMVKYLLNQQRPDGSWGLYYGDGGNLSTTIEAYFALKLAGEHCESEPMRRAREFILSKGGIESARVFTKIWLALFSQYDWDKVPSMPVELVLLPSSLYFNIYEFSSWARGTVVPLSIVMSIRPRCPLPAKCSIKELYVPGSKHKNFASCTHKLFFLFDRIAKAFERRPVPSLRNKAVQAAETWVLDHQEDSGDWGGIQPPMVYSVLALYYLGYPLDHEVIVKGIKALDAFCMEDEEGTRMQSCVSPVWDTALTVLSMLDAGVAAEHPGLEKAGRWLLENQVLTGGDWQIKNDSLPGGWAFEFYNTRYPDVDDSAVVLSTLNRFNAERVEGLEFAKCRGMEWCLSMQSSNGGWAAFDKDNTLEILNRIPFADQEAMVDYPTADVTGRVLEAMGYLGYDGSHPRARKAIQFLKKRQERDGCWWGRWGVNYIYGTWSVLKGLISIGEDPRAAYIRAAVRWVKDHQNSDGGWGETCESYENPELRGQGPSTPSQTAWALMSLIACGEMKSQEASRGIQYLLRTQKRDGTWEELHFTGTGFPKHFYIRYHNYRNCFPLMALGQYLRALER

SEQ ID NO: 246 - protein, 710 aa, Syntrophobacter fumaroxidans
MRRLDTFPPEIPTGSRDKPPSGEEHSCSTPAEPLRSRLDEGILRAVDWLVCDQHPDGFWAGMLQSNSCMEAEWVLAMHFLGIDDDPKYDGVIRAILGEQRADGSWGVFHKAPNGDINTTVECYAALRASGLAPESAPLSSAREWILAGGGLANIRNFTKYWLALIGEWPWEGTPTIPPELIFFPPRMPLNIYHFASWARSTIVPLSILSARRPVRPLPEDRRLDELFPQGRSAFDFRLPRKDGWLSWEGFFHVCDRILRLYARTRRAPFRETAIRVCLEWIIRRQETDGAWSGIQPPWIYALLALHAEGYGLDHPILRAGLRAFDSHWSYERDGGIYLQASESPVWDTVLSLRALADCGEERKASVSIASALEWLLNRQISVPGDWAVRVPSVPCGGWAFQRANSFYPDVDDTAVAIEVLARLRPFTANQSAVDRAIRSARDWVLAMQCSNGGWAAFDRDNDFKLVTKIPFCDFGELLDPPSVDVTAHVIEALAALGWDMTSREIEAAVSFIRREQEAEGSWFGRWGVNHIYGTATVLPALRAIGEDMSSAYVLRAADWLASRQNADGGWGETPASYMDDSLRGVGESTASQTAWAIMGLVAVGSGAHDDTVRRGIDFLLFAQHGGTWEEPQYTGTGFPGYSVGERIRLRDMGASLKQGTELQRAFMINYNLYRHYFPLMALGRARYHLQLRRSAREGGNGETTPNGSAL

SEQ ID NO: 247 - protein, 671 aa, Teredinibacter turnerae
MEIQDEVDLLEPQESLTASADSAVDRALFWLLDAQYEDGYWAGILESNACMEAEWLLCFHVLGIANHPMSRGLVQGLLQRQRADGSWDVYYGARAGDINTTVEVYAALRCQGYAADHPDIKRARDWIQLQGGVKQVRVFTRFWLALIGEWPWEETPNLPPEILFFPRWFPFNIYHFAAWARATLVPLCILSARRMVVPLNKKSCLQELFPEDRSAVVALGKKAGAWSTFFYHADRALKKYQRTFKRPPGRQQAIKMCLEWILRRQDADGAWGGIQPPWIYSLMALKAEGYPVTHPVMAKGLAALDAHWSYERPGGARFVQACESPVWDTLLSSFALLDCGFSCTSSSELRKAVDWILDQQVLLPGDWQQKLPTVSPGGWAFERANVHYPDVDDTAVALIVLAKVRPDYPDTARVNLAIERGLNWLFAMQCRNGGWGAFDKDNDKDLLTKIPFSDFGETIDPASVDVTAHVLEALGLLGYRTTHPAVAKALEFIRSEQENDGCWFGRWGVNYIYGTAAVLPALASLNMNMNQEFIRRAANWILGKQNNDGGWGESCASYMDDTQRGRGPSTASQTAWAMMSLLAVDGGTYAESLLRAEAYLKTTQTPEGTWDEPYYTGTGFPGYGIGRREIKRQRSLQQHAELSRGFMINYNLYRHYFPLMALGRLAALRGA

SEQ ID NO: 248 - protein, 642 aa, Thermosynechococcus elongatus
MPTSLATAIDPKQLQQAIRASQDFLFSQQYAEGYWWAELESNVTMTAEVILLHKIWGTEQRLPLAKAEQYLRNHQRDHGGWELFYGDGGDLSTSVEAYMGLRLLGVPETDPALVKARQFILARGGISKTRIFTKLHLALIGCYDWRGIPSLPPWIMLLPEGSPFTIYEMSSWARSSTVPLLIVMDRKPVYGMDPPITLDELYSEGRANVVWELPRQGDWRDVFIGLDRVFKLFETLNIHPLREQGLKAAEEWVLERQEASGDWGGIIPAMLNSLLALRALDYAVDDPIVQRGMAAVDRFAIETETEYRVQPCVSPVWDTALVMRAMVDSGVAPDHPALVKAGEWLLSKQILDYGDWHIKNKKGRPGGWAFEFENRFYPDVDDTAVVVMALHAVTLPNENLKRRAIERAVAWIASMQCRPGGWAAFDVDNDQDWLNGIPYGDLKAMIDPNTADVTARVLEMVGRCQLAFDRVALDRALAYLRNEQEPEGCWFGRWGVNYLYGTSGVLTALSLVAPRYDRWRIRRAAEWLMQCQNADGGWGETCWSYHDPSLKGKGDSTASQTAWAIIGLLAAGDATGDYATEAIERGIAYLLETQRPDGTWHEDYFTGTGFPCHFYLKYHYYQQHFPLTALGRYARWRNLLAT

SEQ ID NO: 249 - protein, 632 aa, Trichodesmium erythraeum
MIEKNKVKQSILASQKHLLSLQETEGYWWGQLESNVTITAEIILLHKIWQTDKKIPLNKAKNYLISQQREHGGWELFYGDGGDLSTSIEAYMALRLLGVSRTDPIMIEAQNFIIKKGGISCSRIFTKLHLALIGCYSWQGIPSIPSSIMLLPEDFPFTIYEMSSWARSSTVPLLIVFDKKPIFSVNPTINLDELYAEGINNASFELPRKYDLTDLFLGLDKAFKFAENLNLMPLQQEGLKAAEKWILERQEVTGDWGGIIPAMLNSMLALKCLEYDVADPVVVRGLEAIDRFAIENEDSYRVQACVSPVWDTAWVIRSLVDSGISPSHPAMVKAGQWLLQQQILDYGDWVFKNKFGKPGGWAFEFMNRFYPDIDDTAVVVMALDVVELPDEDLKGKAIARGMEWIASMQCEAGGWAAFDVDNNQDWLNATPYGDLKAMIDPNTADVTGRVLEMVGCCGLAMDSWRVKRGIDFLVREQEEEGCWFGRWGVNYIYGTSGVILALAVMARESHRGYIERGASWLVGCQNSDGGWGESCWSYNDPSLKGKGKSTASQTAWALIGLLAAGEGTGNFARDAIDGGVGFLVSTQNDDGSWLEDEFTGTGFPGHFYIKYHFYSQYFPLMALGRYESLLSG

SEQ ID NO: 250 - protein, 233 aa, Unknown
  uncultured organism
SPMWDTVLTTLAVQDAGVDQEPEFKPAMERTLEWLLKNEVRTGGDWQQKTRGVEPGGWAFEYANASYPDNDDTAVALIVLAPFRHDPKWQARGIQHVIDRAVNWMFAMQCDNGGWAAFDLDNDKAILTRIPFCDFGEALDPPSVDVTAHVLEALAALGYSREHPAVRRAIAFLKEDQEPDGSWFGRWGVNFIYGTAAALPALKAMDEDMTQDWITRAADWMRSRQNDDGGWGE

SEQ ID NO: 251 - protein, 233 aa, Unknown
  uncultured organism
SPVWDTVLTMLSVQDCDADENSENAPAIEKAIEWLLANEVRTGGDWQEKVKGVEPGGWAFEYKNASYPDTDDTAVAMMALAPYRTEEKWKKKGLPEALKRAAEWNIAMQCSNGGWGAFDKDNDKTILCKIPFCDFGEALDPPSVDVTAHVLEGLAALDYPPEHPAIQRAVQFIKDEQEPDGSWWGRWGVNFIYGTAAALPALKAVGEDMRAPYIDRAAKWIVDHQNEDGGWGE

SEQ ID NO: 252 - protein, 231 aa, Unknown
  uncultured organism
SPVWDTVLTLLALDDCGYNDCYSEEVDKAVQWVLDQQVLSKGDWSVKLPNVEPGGWAFEYANTRYPDTDDTAVALIVLSQFKDDPKWKERGINQAIERGVNWLFEMQCKNGGWGAFDKDNDKTLLTKIPFCDFGEALDPPSVDVTAHIVEAFGKLGYSKDHPKIAHAIEYLKEEQEADGAWFGRWGVNYVYGTGAVLPALEAIGEDMSQPYIRKAANWLVLHQNEDGGWGE

SEQ ID NO: 253 - protein, 231 aa, Unknown
  uncultured organism
SPVWDTVLTLLAFDDCDKNEAYQASVEKAVQWTLDNQVLRKGDWSVKLPDVEPGGWAFEYANTFYPDTDDTAVALIVLSQFRDVEKWQEAGIEKAIERGVNWLFAMQSKNGGWGAFDKDNDNNFITKIPFCDFGEALDPPSVDVTAHCIEAFGKLGLSRARPEIARGLDYLKSEQEADGAWFGRWGVNYVYGTGAVLPALEAIGEDMSQPYIRKAANWLILRQNEDGGWGE

SEQ ID NO: 254 - protein, 231 aa, Unknown
  uncultured organism
  misc_feature (36)..(36): Xaa can be any naturally occurring amino acid
SPVWDTLLTLLAYDDSGQNERKADEVEKAVDWVLAXQVLRPGDWKVKAPNLEPGGWAFEYANYFYPDTDDTAVALIVLSQFRNDAAWKEKGIEQAIEKGVNWLFGMQCKGGGWGAFDKDNDKQFLTKIPFCDFGEALDPPSVDVTAHIVEAFGKLKFSKDHPNIRRAIDYMKDEQEADGAWFGRWGVNYIYGTGAVLPALEAIGEDMFAPCIGRACDWLVSRQNDDGGWGE

SEQ ID NO: 255 - protein, 231 aa, Unknown
  uncultured organism
SPVWDTLLTLLAYDNSGHNARKASEVEKAVDWVLAQQVLRPGDWNVKAPNLEPGGWAFEYANYFYPDTDDTAVALIVLSQFRNDAAWKDKGIEQAIEKGVNWLFGMQCKGGGWGAFDKDNDRQFLTKIPFCDFGEALDPPSVDVTAHIVEAFGKLKFSKDHPNIRRAIDYTKDEQEDDGAWFGRWGVNYIYGTGAVLLALEAIGEDMSAPYIGRACDWLVSRQNDDGGWGE

SEQ ID NO: 256 - protein, 231 aa, Unknown
  uncultured organism
  misc_feature (180)..(180): Xaa can be any naturally occurring amino acid
SPVWDTLLTLLAIEDSGQSVKRAQEVEKAVDWVLSQQVLRPGDWKVRAPHLEPGGWAFEYANYFFPDTDDTAVALIVLSQFRNDAAWKAKGIETAIEKGVNWLLGMQCKGGGWGAFDKDNDKTYLTKIPFCDFGEALDPPSVDVTAHIVEAFGKLGFSKDHPNIARAIEYLKSEQESDGXWFGRWGVNYVYGVGAVLPALEAIGEDMSAPYIGRACDWLVSKQNSDGGWGE

SEQ ID NO: 257 - protein, 231 aa, Unknown
  uncultured organism
  misc_feature (7)..(7): Xaa can be any naturally occurring amino acid
SPVWDTXLTLLALDDCDLNERQSKEVEKAVQWVLNQQVLRPGDWCVKVPKVQPGGWAFEYKNYFYPDTDDTAVALIVLSQFRDDPKWQEKNIEQAIDRGLNWLIGMQCKGGGWGAFDKDNDKTYLTKIPFCDFGEALDSPSVDVTAHIVEAFGKLGLGKSHPAMIRAIDYLKAEQEQDGAWFGRWGVNYIYGTGAVLPALEAIGEDMRAPYIAKACDWLIAVQQEDGGWGE

SEQ ID NO: 258 - protein, 231 aa, Unknown
  uncultured organism
SPVWDTVLTMLAIHDCGADKQYAPQMDKAIDWLLANEVRHKGDWAVKLPDVEPGGWAFEYSNACYPDLDDTAVALIVLAPYRNDPKWQARDIEGAVERAVDWTLAMQCKNGGWGAFGKDNDKAILTKIPFCDFGEALDPPSVDVTAHVLEALAALGYDNSHPAVARAIRYLRDEQEPDGSWWGRWGVNYIYGTAAVLPALKAMGVDMNEPFVHKAADWIGSVQNEDGGWGE

SEQ ID NO: 259 - protein, 231 aa, Unknown
  uncultured organism
SPVWDTVLTLLAMEDCEATEEHAAAIEQAIEWLLENEVRTPGDWQMKVPDADPGGWAFEYANAAYPDVDDTAVAILVLARYRDDPKWQAKGLPQAIDRAVAWVLAMQCSNGGWAAFDKDNDKSILCKIPFCDFGEALDPATVDVTAHVLEALAAVGYGPDHPAVRRGLDFLYAEQEADGSWWGRWGVNYVYGTGAALPAFKAIGADMRDPRMLKAADWILRCQNKDGGWGE

SEQ ID NO: 260 - protein, 231 aa, Unknown
  uncultured organism
  misc_feature (133)..(133): Xaa can be any naturally occurring amino acid
SPVWDTVLTLLAIQDADKQDDMAAEVDRAIGWLLSKEVRTNGDWSVKLPDVEPGGWAFEHENARYPDTDDTAVAVMVLAPYRHHPKWRKRGLPEALDRAISWMRAMQCRNGGWGAFDKDNDNAFLCVIPFCDXGEALDPPSIDVTAHALEAFAAMGFGPEDTTVARALDYMSKEQEADGSWWGRWGVNYIYGTAAALPAYKAFGQDMRDPKLMKAADYLRAKQNADGGWGE

SEQ ID NO: 261 - protein, 231 aa, Unknown
  uncultured organism
SPVWDTVLTLLAIQDADKQEEMAGEIDKAIGWLLSKEVRTKGDWSVKLPRVEPGGWAFEHENARYPDIDDTAVAIMVLAPYRDHPKWKKRGLPEALDRAIAWMRAMQCRGGGWGAFDKDNDKQILCTIPFCDFGEALDPPSIDVTAYALEAFAAMGYGPDDKTVARALKYMSKEQEADGSWWGRWGVNYIYGTAAALPAYKALGQDMRDPGLMKAADYLRDKQNADGGWGE

SEQ ID NO: 262 - protein, 231 aa, Unknown
  uncultured organism
SPVWDTVLTLLAMQDADRTDKHKAAVDKAIQWVLDQEVRTPGDWCVQTPDVEPGGWAFEYENARYPDVDDTAVAIMVLAPYQDDPKWRKRGLPDALARAIAWIRAMQCKNGGWGAFDRDNDNSMLTVIPFCDFGEALDPPSVDVTAHALEAFHMMGYGPEDPTVARALAYLDAEQEQDGSWWGRWGVNFIYGTSAALPALKAMGRDMRDPRYTKAADYLRAVQNDDGGWGE

SEQ ID NO: 263 - protein, 231 aa, Unknown
  uncultured organism
SPVWDTSLILNALLAGSEKTETDPKILKAGQWLLDREVREIGDWKIKNNRGPVGGWYFEYANEFYPDCDDTAEVITVLNQMQFSDPEKEKAKQVAQQRGLDWLLSMQNKDGGWPAFDKNCDKQSLTYMPFADHNAMIDPSYEDITGRTLEALASLGFSEDDPIVRRAVDFLKSKQLPDGTWYGRWGCNFLYGTWLAISGLYHAGEDLNEERYQSLLSWLEQCQNEDGGWGE

SEQ ID NO: 264 - protein, 230 aa, Unknown
  uncultured organism
SPVWDTLLTLEALLDCNLSPKTFTGMQAAVDWILSKQIVTPGDWQIKVPGVSCGGWAFERANTFYPDMDDTAVAMIVLARIRRYYNDSSRIDRALACATDWILSMQCSNGGWAAFDLDNTNDLVTRIPFSDFGEMLDPPSVDVTAHVVEALGCLGRTRNDPAVARAVAYILDEQEPEGSWFGRWGVNHIYGTGAVLPALAAVGTDMSAGYITRAADWVATHQNADGGWGE

SEQ ID NO: 265 - protein, 230 aa, Unknown
  uncultured organism
SPVWDTTNAMTAVLDAGLPGNHPAVLRAARWLLSKEVRMPGDWRLWYKNGEPGGWFFEYNNEFYPDADDTAEALHCLCRVVFDCEDEMDRCRAAIKRGLNWQFACQNPDGGWPAFDKECDDEYLTFIPFADHNAMIDPSCCDITGRSLQALSKLGYTTNDVDVKRAIDYLLDAQEDDGTWYGRWGINYIYGTWLAVQGLRAIGVDLSEKRFQKVTKWLRKKQNPDGGWGE

SEQ ID NO: 266 - protein, 230 aa, Unknown
  uncultured organism
  misc_feature (208)..(208): Xaa can be any naturally occurring amino acid
  misc_feature (224)..(224): Xaa can be any naturally occurring amino acid
SPIWDTGIVLHSLVESGVSPDHEALLRSVSWLLAKEVTHEGDWKVKCPDAPVGGWYFEYANEFNPDCDDTAKVLMATSRFSSVDFPDAGRLRDARNRGLQWLLHMQNKDGGWAAFDKGCDNELLTYIPFADHNAMIDPSTEDITGRVLETLAREGFDNTHPVVKRAIQYLHKTQDAEGPWYGRWGSNFIYGTWLVLQGLKAVGEDMTXPRYQRAANWLLNVQNXNGSWGE

SEQ ID NO: 267 - protein, 230 aa, Unknown
  uncultured organism
SPVWDTAISVIALAESGLHRGHPSLVQATEWLVANEIRRGGDWQVKNPTAPISGWAFEFKNDFYPDVDDTAMVLLALRHVHLYNDDVSQDREKSYLRGLNWMLSMQCKNGGWAAFDRDNVKTIFEKIPFADHNAMIDPPSVDITGRVLELLGYVGYDKSYPCVTKALEYIKKDQEADGSWYGRWGVNYIYGTWQVLRGLAAIGEDMQSEYVQKAVRWMKSVQNPDGGWGE

SEQ ID NO: 268 - protein, 229 aa, Unknown
  uncultured organism
  misc_feature (111)..(111): Xaa can be any naturally occurring amino acid
SPVWDTCLILNSMLEHLEPDHPRVQKAAEWLLSKEVTEPGDWQVKCPEAPVGGWYFEYANEFYPDCDDTAEVLAALQRVQFTDADREAQKRGAIQRGLGWLLAMQNQDGGXAAFDRECTREALTYVPFADHNAMIDPSNGDITGRVLKALDYAGYSPDDPIVRGGVDFLLANQEPDGTWYGRWGCNHLYGSWLVVWGLKHAGVNLQQTQFTQVMSWLESCQNADGGWGE

SEQ ID NO: 269 - protein, 229 aa, Unknown
  uncultured organism
SPVWDTCLILNSLLEHLEPDHPRLQHAAEWLLSKEVTEPGDWQVKCPEAPIGGWYFEYANEFYPDCDDTAEVLAALQRVRFSDADREAQKHAAIERGLGWLLAMQNGDGGWAAFDRECTREALTYVPFADHNAMIDPSNGDITGRVLKALDYSGRSPQDPVVQGGVHFLLANQEPDGTWYGRWGCNHLYGSWLAIWGLKHAGVDSQQSQFMRLLSWLESCQNPDGGWGE

SEQ ID NO: 270 - protein, 229 aa, Unknown
  uncultured organism
SPVWDTALAMSALLEGDTAPDDEALQRGCRWLLGKEVRHRGDWQVNVGAEPGGWFFEYENEFYPDCDDTAEVLAVLERVRLSDPEEDQRRRDALDRALAWQLGMQSTNGGWGAFDKDCDHRILELVPFADHNAMIDPPTVDVTSRSIEAALAMGVPASDAAIRRAVRFLYSEQEADGSWYGRWGSNYLYGTWLALCALRSAGEDLTSPAVQRAVEWLLSVQQEDGGWGE

SEQ ID NO: 271 - protein, 295 aa, Unknown
  uncultured organism
  misc_feature (15)..(15): Xaa can be any naturally occurring amino acid
  misc_feature (30)..(30): Xaa can be any naturally occurring amino acid
SPVWDTAISVISLAXSGMERGHPALVRAAXWLMSKEIKTAGDWKVTNPAGPVGGWAFEFNNAFYPDIDDSAMVMMALRHVHLDEHTAHRREKACLRGLNWLLSMQSRTGGWAAFDKDNTKVIMTKIPFADHNAMIDPPWADITGRVLEFLGYIGYDQSYPAVARAARFLREEQEEDGSWFGRWGVNYIYGTWQVLRGLAAIDEDMSQPYIRRAAEWLRSVQPPDGGWGETCATYHDPSLKGKGPATPAQTAWAVMGLMAAGIYDESVSRGIDYLVRTQRPDGTWDETEYTGTGFP

SEQ ID NO: 272 - protein, 231 aa, Unknown
  uncultured organism
SPVWDTGLVALALQEVDKHNSQDALQRNLKQAYSWLLSKQLKDEPGDWRISKPTLTGGGWAFQFNNPHYPDVDDTAVVAFALAQAEHTELDESIHLATRWIEGMQSQNGGYGAFDVDNTFYYLNEIPFADHGALLDPPTADVSARCAMLMARVAKDHEEYLPALERTIQYLRSEQEADGSWFGRWGTNYVYGTWSVLLGLEQTNVPKTDPLFTKAAQWLKSVQRPDGGWGE

SEQ ID NO: 273 - protein, 231 aa, Unknown
  uncultured organism
SPVWDTGLVALALPEVDKHNSQDALQPNLKQAYSWLLSKQLKDQPGDWRISKPTLTGGGWAFQFNNPHYPDVHDTAVLAFALAQAEHTELDESIHLATRWIEGMQSQNGGYGAFDVDNTFYYLNEIPFADHGALLDPPTADVSARCAMLMARVAKGHEEYLPALERTIQYLRSEQEADGSWFGRWGTNYVYGTWSVLLGLEQTNVPKTDPLFTKAAQWLKSVQRPDGGWGE

SEQ ID NO: 274 - protein, 232 aa, Unknown
  uncultured organism
SPVWDTILSMQALLDTKEVFQPSPTLKKAMEWLLEQQVRAWGDWKVYVSDARGGGWAFQRANSFYPDVDDTIMVMMALRNVSPRGESKVVDEAIERALFWVLGMQCEDGGWAAFDRDNAKAFLTKVPFADHNAMIDPSTADLTSRTFEMFAMIAPEVFTIHHPVVRRGLEFLKKDQCKDGSWFGRWGVNYMYGTWQVLRGLRLIGEDMSKGYVRKGVEWFKSVQLEDGGWGE

SEQ ID NO: 275 - protein, 228 aa, Unknown
  uncultured organism
SPVWDTLLALLALQDCDRELTAEMSRALDWVLANEVRYHGDWTKKVKGVEPSGWAFERANLNYPDIDDTAVALIVLARLPRAWLDEPRIRATIDRVLGWTLAMQSSNGGWAAFDKDNDRPIITKIPFCDFGEALDPPSADVTAHVLEALGLLGFDRRHPAVERGLRFLRSEQEADGSWFGRWGVNYVYGTAAVLPGLAAIGEDMTQDYIRRANDWLIAHQNPDGGWGE

SEQ ID NO: 276 - protein, 204 aa, Unknown
  uncultured organism
  misc_feature (201)..(201): Xaa can be any naturally occurring amino acid
SPVWDTLLTLLAMEDCDRGLTPSMQRALEWVLAQEVRYAGDWSKKVKGVEPSGWAFERANLNYPDIDDTAVALIVLARLPRAWLDEPRIRATIDRVLGWTLAMQSSNGGWAAFDKDNDRPIITKIPFCDFGEALDPPSADVTAHVLEALGLPGFDRRHPAVERGYKFLRSEQEADGSWFGRWGVNHIYGTAAVLPALASIXEDM

SEQ ID NO: 277 - protein, 228 aa, Unknown
  uncultured organism
SPVWDTLLALLAMQDCERELTPQMERALDWVLANEVRYYGDWSKKVRGVEPSGWAFERANLNYPDIDDTVVALIVLARLPRALLDQPRIRAVIDRALGWTLAMQSSNGGWAAFDKDNDHLIITKIPFCGFGEALDPPSADVTAHVLEALGLLGFDRHHPAVARGYQFLRKEQEADGSWFGRWGVNHIYGTAAVLPALAAIGEDMSQPYIRAAAEWIIAHQNADGGWGE

SEQ ID NO: 278 - protein, 204 aa, Unknown
  uncultured organism
  misc_feature (198)..(198): Xaa can be any naturally occurring amino acid
SPVWDTLLSLLAMQDCERGFTPSMERALDWVLANEVRYYGDWSKKVRGVEPSGWAFERANLNYPDIDDTAVALIVLARLPRAQLDQPRIREVIDRALGWTLAMQSSNGGWAAFDKDNDHLIITKIPFCDFGEALDPPSADVAAHVLEALGLLGFERKHPAVERGLKFIRSEQEADGSWFGRWGVNHIYGTAAVLPALXAIGEDM

SEQ ID NO: 279 - protein, 228 aa, Unknown
  uncultured organism
  misc_feature (9)..(9): Xaa can be any naturally occurring amino acid
  misc_feature (31)..(32): Xaa can be any naturally occurring amino acid
  misc_feature (57)..(57): Xaa can be any naturally occurring amino acid
  misc_feature (102)..(102): Xaa can be any naturally occurring amino acid
  misc_feature (131)..(131): Xaa can be any naturally occurring amino acid
  misc_feature (191)..(191): Xaa can be any naturally occurring amino acid
SPVWDTLLXLLAMQDCERESTPSMERALDWXXANEVRYYGDWSKKVRGVEPSGWAFXRANLNYPDIDDTDVALIVLARLPRALLDQSRVHAVIDRALGWTLXMQSSNGGWAAFDKDNNHLIITKIPFCDFXEALDPPSADVTAHVLEALGLLGFNRNHPAVERGYRFLRSEQETDGSWFGRWGVNHVYGTXAVLPALAAIGEDMTQPYIRSAAEWIIAHQNADGGWGE

SEQ ID NO: 280 - protein, 228 aa, Unknown
  uncultured organism
SPVWDTLLSLVALQDCGKELTPARERALEWILGREIRTRGDWAKKVKNVEASGWAFERANLHYPDIDDTAVALIMLARLPRAWLDQPRIRAVIDRALGWTLAMQSSSGGWAAFDKDNDRLIITKIPFCDFGEALDPPSADVTAHVLEALGILGFDRQHAAVRHGLKFLRSEQEADGSWFGRWGVNHVYGTGAVLPALAAIGEDMAQDYVRRAADWLVAHQNADGGWGE

SEQ ID NO: 281 - protein, 228 aa, Unknown
  uncultured organism
SPVWDTLLTLLAYQDCELEMNDSAGRALDWILSQENSYRGDWAHRNKKLEPSGWAFERANLHYPDIDDTSVALIVLARLPQAVRSRPDIKSAIDRALAWTLGMQCRNGGWAAFDRDNDKLIITMIPFCDFSEALDPPSADVTAHVVEAMAHLGFDRSHKAVEKAYQYLLAEQEDDGSWFGRWGVNHIYGTAAVLPALAALGEDATVPHVKRAADWISAHQNTDGGWGE

SEQ ID NO: 282 - protein, 228 aa, Unknown
  uncultured organism
SPMWDTSLAAHALMEADGRGDPKDNPRLISAMDWLADKQILDHVGDWAVRRPDVRPGGWAFQYENPDYPDVDDTAVVVMAMHRADPERYEMSIDRACEWLVGMQSKNGGWGAFEPENEHYYLNSIPFADHGALLDPPTVDVTARCVGALAQVDRDRYAAEIANGIRSIRREQEDDGSWFGRWGANYVYGTWSALVALKGAGEDMQQPYIRRAVDWLKARQRSDGGWGE

SEQ ID NO: 283 - protein, 228 aa, Unknown
  uncultured organism
SPVWDTCLTSNALVESGGDTSAPHVHRSVQWLLNQEIRNHGDWSVKAPKVGPSGWAFEFANKVYPDVDDAAEVIIALANYSNDSGTAPPDAIARGVRWISGMQSSNGGWGSFDKNNTSFFVTRLPFFDFGEVIDPPSVDVTAHVIEALAVAGWQEKASKQIQKALDYIWSEQEADGPWFGRWGINYIYGTCAVLSALEAIGYDMADARVVKALKWIEECQNADGGWGE

SEQ ID NO: 284 - protein, 228 aa, Unknown
  uncultured organism
SPVWDTVAQLHALIASGLARRDEALRRAASWLLTRQSRTHGDWSGRNPAEPGGFYFEFRNEFYPDVDDTAMALMVLTQAEANVATDVQHAAIARALAWMLGMQNRDGGWAAFDRDNDKHFLTQVPFADHNAMIDPSTADITGRVLGALSHVPSYGPDHPSVRRAIAFLQRDQEPDGSWYGRWGVNYLYGTGQVLRGLRAIGFDMQQPFVRRAARFLSAHQNDDGGWGE

SEQ ID NO: 285 - protein, 227 aa, Unknown
  uncultured organism
SPVWDTAITIIALAESGLPKNHPAFEQAATWLEKKEIRFKGDWAVRMPGVEPSGWAFEHENKYYPDTDDTMMVLMALRHVQSRNSAERCEQFDRALKWLLAFQCQDGGWAAFDKDVTASWLEHVPFADHNAILDPTCSDLTARVLELLGSISFDRQSAIVRRAVAMMRRTQETDGSWYGRWGVNYIYGTWQALRGLAAIGENMDQEWIRRGRDWLESCQNDDGGWGE

SEQ ID NO: 286 - protein, 227 aa, Unknown
  uncultured organism
SPVWDTAINVISLAESGLLSDHPALQKAADWLVNKEVRFRGDWSVNNSYPQVSGWAFEYNNVYYPDTDDTAMVLMALRLIRPKDPQALNELFRRALDWQLSFQCRDGGWAAFDKNVTTPWLEDMPFADHNAILDPTCSDLTARTLELLGYTGFDPKAQSVRDALQYLIDTQDEDGSWYGRWGVNYIYGTWQVLRGLRAMGQDMTQDWILRGRDWLESCQNSDGGWGE

SEQ ID NO: 287 - protein, 227 aa, Unknown
  uncultured organism
SPVWDTAITSVALTSSGVKPDHPQIQKAADWLLDREVVMRGDWKVKNPYPHASGWAFEFNNDFYPDADDTFKVLLALMKMKSSDPERQRKIMDRALDWARSFQCKDGGFAAFDKDVTKKWLEHVPFADHNAILDPSCSDITARGLECMGKLGWPRTDRVIRRAIRYLKKTQEEDGSWWGRWGVNYIYGTWQSLRGLEAIGEDMNQDWVVRARNWLESCQNPDGGWGE

SEQ ID NO: 288 - protein, 227 aa, Unknown
  uncultured organism
SPVWDTAITAVSLAESGLEPDHPALQKSAEWLLDKEVRIQGDWAIKNRHGEASGWAFEFNNEFYPDVDDTLKVLLALRLIKTRDEETKREAMERALGWVMSFQCSDGGWAAFDKDVTQRWLEDVPFADHNAILDPTCSDITARCLELLGKMGCTSDHPAVRRALRMVRETQEPDGTWWGRWGVNYIYGTWQILRGLSALKIDMNQDWIVRAKEWLESCQNPDGGWGE

SEQ ID NO: 289 - protein, 227 aa, Unknown
  uncultured organism
SPIWDTAIVTMAIAESGQDPNDPRLQKAADWLLEREIGFRGDWRENCDFPEATGWAFEFNNDWYPDVDDTFQVILGLKPLSASDSRRQEQTLDRAIRWCRAMQCREGGFAAFDKDINDAWLNEVPFADHNAILDPPCSDITGRALETLSLMGFDREDPVVRRARQYLMETQLEDGSWFGRWGVNYIYGTGHALRGLHAIGEDINGSAMQRARNWLENCQNDDGGWGE

SEQ ID NO: 290 - protein, 231 aa, Unknown
  uncultured organism
SPIWDTAKAVNALHESGLPSDHPQLKAAARWLVEKEVRKPGDWKMRVPHVDVGGWPFQFRNEFYPDVDDTAAVVMALGRVDERDVPGIKDSITRGINWVTQMQCSCGGWAAFDVDVKREFLTKVPYADHNAMLDPPCPDITGRCLEMYGRFPGVRKDADVQRVIEKGIEYLKKTQEPDGSWYGRWGVNYIYGTWQSLKGLAAVGEDPSQPYIQKAAHFLKTHQNSDGGWGE

SEQ ID NO: 291 - protein, 231 aa, Unknown
  uncultured organism
SPMWDTAKAVNALHESGLPSDHPQLKAAARWLVEKEVQKPGDWKMRVPYVDVGGWPFQFRNEFYPDVDDTAAVVMALGRVDERDVPGIKDSITRGINWVTQMQCSCGGWAAFDVDVKREFLTKVPYADHNAMLDPPCPDITGRCLEMYGRFPEVRKDVDVQRVIEKGIEYLKKTQEPDGSWYGRWGVNYIYGTWQSLKGLAAVGEDPSQPYIQKAAHFLKTHQNSDGGWGE

SEQ ID NO: 292 - protein, 231 aa, Unknown
  uncultured organism
SPVWDTAKAVNALHESGLPSDHPQLKAAARWLVEKEVRKPGDWKMRVPHVDVGGWPFQFRNEFYPDVDDTAAVVMALGRVDERDVPGIKDSITRGINWVTQMQCSCGGWAAFDVDVKREFLTKVPYADHNAMLDPPCPDITGRCLEMYGRFPEVRKDANVQNVIAKGIEYLKKTQEPDGSWYGRWGVNYIYGTWQSLKGLAAVGEDPSQPYIQKAAHFLKTHQNSDGGWGE

SEQ ID NO: 293 - protein, 227 aa, Unknown
  uncultured organism
SPVWDTCLSLAALTEAGAQNDHPAVKQAVEWLLDHQIFVEGDWCAQASGLEPGGWAFQYENDKYPDVDDTGMVLMSLLRAGVHDKEHKRKRVNQALNWVLGMQNPDGSWGAFDIENNYEYLNKIPFADHGALVDPGTADLTARCVELLAMLGYDATFPPVKRALEFLEHDQEEDGSWYGRWGVNYIYGTWSVLCALGAIGEDVAKPYVRKSVQWLQDTQNEDGGWGE

SEQ ID NO: 294 - protein, 227 aa, Unknown
  uncultured organism
SPVWDTCLSLAALTEAGAQNDHPAVKQAVEWLLDHQIFVEGDWCDQAPGLEPGGWAFQYENNKYPDVDDTGMVLMSLLRAGVHDKEHKRKRVNQALNWVLGMQNPDGSWGAFDIENNYEYLNRIPFADHGALVDPGTADLTARCVELLAMLGYDATFPPVKRALEFLEQDQEEDGSWYGRWGVNYIYGTWSVLCALGATGEDVAKPYVRKSVQWLQDTQNEDGGWGE

SEQ ID NO: 295 - protein, 227 aa, Unknown
  uncultured organism
SPVWDTCLSLTAMTESGAHPEHPAVKQAVEWLLDQQIFVKGDWADQAKNLEPGGWAFQFENDRCPDVDDTGMVLMALLRAGVQDKEHKIKRINQAVNWVLGMQNPDGSWGAFDIGNDHEYLNNIPFADHGALVDPGTADLTARCVELLAMLGYGPDFPPIQRAVAFLERDQEEFGAWYGRWGVNYIYGTWSVLSAIGILGEDYAKPYVRKAVEWLKEIQNDDGGWGE

SEQ ID NO: 296 - protein, 227 aa, Unknown
  uncultured organism
SPVWDTCLSLNALTEADMPANDPRVRAAVQWLFDRQIFVRGDWSENAPELEPGGWAFQYENDKYPDVDDTGMVLMSLLRANAHEHDAQRKRMNQALNWVLGMQNSDGSWGAFDIDNHYTYLNNIPFADHGALVDPGTADLTGRCIELFGMLGYDKNFTPARRGIEFLKRDQHPCGGWYGRWGVNYLYGTWSVLTALGAIGEARDAPYLRRAVEWLYSVQNDDGGWGE

SEQ ID NO: 297 - protein, 227 aa, Unknown
  uncultured organism
SPVWDTALVLQAMQEASIPLDHPALVKAAQWLLDREVRIKGDWKIKSPGLEPGGWAFEFQNDWYPDVDDSAAVLIAIKDIQVKNNKAKQGAVRRGIDWCLGMQSKNGGWGAFDKDNTKHLLNKIPFADLEALIDPPTADLTGRMLELMGNFGYDKHHPQAVHALEFLKKEQEPEGPWFGRWGVNYIYGTWYVLIGLEAIGEDMNQPYIKKAANWIKSRQNIDGGWGE

SEQ ID NO: 298 - protein, 227 aa, Unknown
  uncultured organism
  misc_feature (78)..(78): Xaa can be any naturally occurring amino acid
SPVWDTTLVLVAMQEAGVPVDHPALVKSAQWLLDLEVRRKGDWQVKSPDVEPGGWAFEFMNDWYPDVDDSGFVMLAIXNIRVRDKKHQEQAIKRGIAWCLEMQSENGGWGAFDKDNTKYLLNKIPFADLEALIDPPTADLTGRMLELMGNFDYSASYPAAVRALEFLKKEQEPEGPWWGRWGVNYIYGTWSVLCGLEAIGEDMSQPYIRKAVNWLKSKQNLDGGWGE

SEQ ID NO: 299 - protein, 294 aa, Unknown
  uncultured organism
SPVWDTALVLVAMQEAGVPVDHPALIKSAQWLLDLEVRRKGDWHVKSPDLEPGGWAFESLNDWYPDVDDSGFVMLFIKDIKVRDKKLKDQAIKCGIAWCLGMQSENGGWGAFDKDNTKHLLNKIPFADLEALIDPPTADLTGRMLELMGNFNYPKSHQAAVKALDFLKVEQEPEGPWWGRWGVNYIYGTWSVLCGLEAIGEDMSQPYIKKAVNWLKSKQNLDGGWGEVCDSYADRSLMGCGPSTASQTSWALLSLFAAGEVSSKAALRGVEYLLSTQKLDGTWDEDAFTGTGFP

SEQ ID NO: 300 - protein, 294 aa, Unknown
  uncultured organism
  misc_feature (15)..(15): Xaa can be any naturally occurring amino acid
  misc_feature (21)..(21): Xaa can be any naturally occurring amino acid
  misc_feature (38)..(39): Xaa can be any naturally occurring amino acid
  misc_feature (58)..(58): Xaa can be any naturally occurring amino acid
  misc_feature (79)..(79): Xaa can be any naturally occurring amino acid
  misc_feature (128)..(128): Xaa can be any naturally occurring amino acid
  misc_feature (139)..(139): Xaa can be any naturally occurring amino acid
  misc_feature (168)..(168): Xaa can be any naturally occurring amino acid
  misc_feature (171)..(171): Xaa can be any naturally occurring amino acid
  misc_feature (174)..(174): Xaa can be any naturally occurring amino acid
SPVWDTALVLVAMQXAGVPVXHPALVKSAQWLLDLEVXXKGDWQVKSPELEPGGWAFXFLNDWYPDVDDSGFVMLSIKXIKVRDKKHKEQAIKRGISWCLGMQSDNGGWAAFDKNNTKYLLNKIPFAXLEALIDPPTAXLTGRMLELMGNFNYPKTHKAAVQALEFLXMEXEPXGPWWGRWGVNYIYGTWSVLCGLEAIGEDMAQPYIKKSINWLKSKQNMDGGWGEVCESYGDRSLMGCGPSTASQTSWALLSLFAAGEVHSKAATRGIEYLLATQKLDGTWDEDAYTGTGFP

SEQ ID NO: 301 - protein, 227 aa, Unknown
  uncultured organism
SPVWDTALALVAMQEAGVPKDHPALVKAAQWLLDLEVRRKGDWQIKSPELEPGGWAFEFLNDWYPDVDDSGFVIMAIRDIKAPDKKHKEQAIKRGIAWCLGMQSKNGGWGAFDKDNTKHLLNKIPFADLEALIDPPTADLTGRMLELMGSFDYPMDHPAAARALEFLKKEQEPEGPWWGRWGVNYIYGTWSVLCGLESIGEDMSQPYIKKAVNWLKSKQNMDGGWGE

SEQ ID NO: 302 - protein, 294 aa, Unknown
  uncultured organism
SPVWDTSLVLVAMQEAGVPVDHPALVKAAQWLLDREVRLKGDWRVKSPDLEPGGWAFEFLNDWYPDVDDSGFVMLALKDIKVRDKKQKSQAIKRGIAWCLGMQSANGGWGAFDKDNTKYLLNKIPFADLEALIDPPTADLTGRMLELMGTFNYPKSHVAVVRALGFLKSVQEPEGPWWGRWGVNYIYGTWSVLGGLDAIGEDMSQPYIRKAVNWLKSKQNLDGGWGEVCETYEDRSLMGCGPSTPSQTSWALLSLFSAGEINAKAVLRGIKYLVETQNQDGSWDEDAYTGTGFP

SEQ ID NO: 303 - protein, 227 aa, Unknown
  uncultured organism
SPVWDTALVLVAMQEAGVPLDHPALVKAAQWLLDREVRIKGDWRIKSPDIEPGGWAFEFLNDWYPDVDDSGFVMLAIKDVKVRDKKKKEQAIKRGINWCLGMQSANGGWGAFDKDNTKYLLNKIPFADLEALIDPPTADLTGRMLELLGTFNFPKDHHAIERALEFIQLEQEPEGPWWGRWGVNYIYGTWSVISGLEAIGEDMSQPYIRKTVNWLKSKQNMDGGWGE

SEQ ID NO: 304 - protein, 294 aa, Unknown
  uncultured organism
  misc_feature (22)..(22): Xaa can be any naturally occurring amino acid
SPVWDTPWMVMALLEAGVPTDXPGLLRAGRWLISKQITGVHGDWAVKNRHALPGGWSFEFENDYFPDVDDTIEVLHVIHRLAIPWEEKSECCRLGLDWLLSMQNDDGGWGAFDRNQTLVMVNRIPFSDHAACLDPSSPDIVGRVLEFLASRSFSREHPAVKRALDYIWREQSPFGGWWARWGIDYLYGTWCVLTGLRAIGWDMEDPRVRKAVAWLESVARPDGGYGESPESYRDHSYVEWKRSVPSQTAWALMGLVAGGVGHGKAARGAADYLLTSRNAQGGWDEMDYTGTGFP

SEQ ID NO: 305 - protein, 294 aa, Unknown
  uncultured organism
  misc_feature (24)..(24): Xaa can be any naturally occurring amino acid
  misc_feature (36)..(36): Xaa can be any naturally occurring amino acid
  misc_feature (99)..(99): Xaa can be any naturally occurring amino acid
  misc_feature (103)..(103): Xaa can be any naturally occurring amino acid
  misc_feature (117)..(117): Xaa can be any naturally occurring amino acid
  misc_feature (151)..(151): Xaa can be any naturally occurring amino acid
  misc_feature (173)..(173): Xaa can be any naturally occurring amino acid
  misc_feature (202)..(202): Xaa can be any naturally occurring amino acid
SPVWDTPWMVMALLEAGCPANDPXLIRAGRWLKAKXITEVRGDWAVKNRKALPGGWSFEFENDYFPDVDDTIEVLSVIHRLSIPWNEKAKSCRLGLEWXLSMXNRDGGWGAFDREQXFKVVNRIPFSDHAACLDPSSPDITGRMVEFLASXNFSKGHVAVRRALDYIWKQQAXFGGWWARWGIDYLYGTWCVLTGLASLGFXMDDPRARKAADWLESIQHADGGFGESPESYREDSFVDWKRSVPSQTAWALMGLVAAGRASGAAAQRAAAWLLDNRNTNGSWDEQDYTGTGFP

SEQ ID NO: 306 - protein, 294 aa, Unknown
  uncultured organism
SPVWDTPWTVMALLEAGVPSNDPALLRSGRWLLAKQITDTKGDWAIKNKNTAPGGWSFEFENKYFPDVDDTIEVLHCLHKLAIPWREKEKPCRLGIDWLLSMQNDDGGWGAFDKNQKRQVVNRIPFSDHGACLDPSSPDITGRMIEFLATQKFNSEYESVKRALKYIWKTQEDFGGWHARWGINYIYGTWCVLTGLRAIGFNMTDRRVQKALNWLESIQNKDGGFGESPASYEECRYIPWKESVPSQTAWALMALVAGGGAGSAPAENAATFLINYRNSNGVWDEECYTGTGFP

SEQ ID NO: 307 - protein, 295 aa, Unknown
  uncultured organism
SPVWDTPWMIEALLETGVPPGDPALLRAGRWLMSKQITGVRGDWAMKSPKGKPGGWAFEFENDYYPDVDDTIQVLTALCKLSIPWREKEKAVMQGIDWLISMQNDDGGWGAFDRNQTRWIVNRIPFSDHKACLDPSSPDITGRMVEFLMRRNYSTSHPSVKKALKYIRETQEDFGAWFARWGINYIYGTWCVLTALAAMGIGHTDSRVAKAVAWLSSVQRPDGGFSEAADTYHPHKPFESYSESVPSQSAWALMGLVAGGAVHSPAAARAACYLINNRNLNNGWDERHYTGTGFP

SEQ ID NO: 308 - protein, 226 aa, Unknown
  uncultured organism
SPVWDTAIAGYALGESGCAPQSALRRMADWLLTKEVRRKDDWSVKRPDVEPSGWYFEFANEFYPDTDDTAMVLLSLLHGRATNPAAQEACAKRAVNWLLAMQSKDGGWAAFDVDNDWKPLSYVPFADHNAMLDPSCPDITGRVLEALCKYGVSQEHPAVLRAIDYLIQTQEQDGSWHGRWGVNYVYGTFLALRGLKAAGVSDREAYVLRAGEWLDLIQNPDGGWGE

SEQ ID NO: 309 - protein, 226 aa, Unknown
  uncultured organism
SPVWDTVLSITALADADLPRTHPAMRRAVAWVLGKQVLCEGDWRVKNRRGEPGGWSFEFNNNFYQDNDDTAAVLIALHKARLPDEAKGEAMQRGLRWLLSMQCDDGGWSAFDVNNNKRLLNKIPFADLESMLDPSTCDLTGRTLEALGSIGFPFTHRIVQHAVRFIRQHQEADGAWYGRWGVNYIYGTCHVLCGLLSVGEDMHQPYVQRAVQWLIEHQNADGGWGE

SEQ ID NO: 310 - protein, 226 aa, Unknown
  uncultured organism
SPVWDTALAVRALAAAGLPPEHPAMVKASEWLLTQQIFKPGDWSVKCPDLPPGGWAFEFVNNWYPDVDDSSMVLVALKEGLADAAKHQAALQRGINWCLGMQSKNGGFASFDKDNTKEWLNAIPFGDLKALVDPPTEDITARILEMMGAFGHGLDHPVAVRGLAYLHQTQRPEGPWWGRWGVNYIYGTWSVLVALKRIGEDMSRPYVRRAVDWVKAHQNPDGGWGE

SEQ ID NO: 311 - protein, 226 aa, Unknown
  uncultured organism
SPVWDTALAVRALAAAGLPPEHPAMVKASEWLLTQQIFKPGDWSVKCPDLPPGGWAFEFVNNWYPDVDDSSMVLVALKDGLVDAAKHQAALQRGINWCLGMQSKNGGFASFDKDNTKEWLNAIPFGDLKALVDPPTEDITARILEMMGAFGHGLDHPVAVRALAYLHQTQRPEGPWWGRWGVNYIYGTWSVLVALKRIGEDMNRPYVRRAVDWVKAHQNLDGGWGE

SEQ ID NO: 312 - protein, 293 aa, Unknown
  uncultured organism
SPVWDTALAVRALAAAGVPPEHPAMVQASEWLLTQQIFKPGDWSVKCPDLPPGGWAFEFVNNWYPDVDDSSMVLVALKDGLADAAKHQAALQRGINWCLGMQSKNGGFASFDKDNTKEWLNAIPFGDLKALVDPPTEDITARILEMMGAFGHGLDHPVAVRAMAYLHETQRPEGPWWGRWGVNYIYGTWSVLVALKRIGEDMSRPYVRRAVDWVKAHQNLDGGWGECCESYRNPELMGRGPSTASQTAWALLGLFASGEVHTPEVKAGVDYLVKTQNSLGRWDEEQFTGTGFP

SEQ ID NO: 313 - protein, 226 aa, Unknown
  uncultured organism
SPIWDTALAVRALTAAGMPPEHPAMVKASEWLLTQQIFKPGDWSVKCPDLPPGGWAFEFVNNWYPDVDDSSMVLVALKEGLADTAKHQAALQRGINWCLGMQSKNGGFASFDKDNTKEWLNAIPFGDLKALVDPPTEDITARILEMMGAFGHGLDHPVAVRALAYLHETQRPGGPWWGRWGVNYLYGTWSVLVALKRIGEDMSRPYVRRAVDWVKDHQNLDGGWGE

SEQ ID NO: 314 - protein, 293 aa, Unknown
  uncultured organism
SPVWDTALAVRALAAAGVPPEHPAMVKASEWLLTQQIFKPGDWSIKCPDLPPGGWAFEFVNNWYPDVDDSSMVLVALKDGLADAAKHQAALQRGINWCLGMQSKNGGFASFDKDNTKEWLNSLPFGDLKALVDPPTEDITARILEMMGAFGHGLDHPVAARALAYLHQTQRPEGPWWGRWGVNYIYGTWSVLVALKRIGEDMSRPYVRRAVDWVKAHQNPDGGWGEFCESYRNPELMGKGPSTASQTAWALLGLFAAGEVHAPEVTAGVDYLVKTQDSLGRWDEEQFTGTGFP

SEQ ID NO: 315 - protein, 293 aa, Unknown
  uncultured organism
  misc_feature (57)..(57): Xaa can be any naturally occurring amino acid
  misc_feature (58)..(58): Xaa can be any naturally occurring amino acid
  misc_feature (200)..(200): Xaa can be any naturally occurring amino acid
SPVWDTALAVRALAAAGLPPDHPFMTQATSWLLTQQIFKPGDWCIKCPDLPPGGWAFXFHNNWYPDVDDSSMVLVALKDGLPDTARHQAALQRGINWCLGMQSKNGGFASFDKDNTKEWLNALPFGDLKALVDPPTEDITARILEMMGAFGHGLDHPTADRALAFLRRTQHPEGPWWGRWGVNYLYGTWSVLVALKRIGXDMSRPYVQRAVNWIKSHQNPDGGWGEVCESYRHPELMGQGPSTASQTAWALLGLLAAGEIQAAEVKAGVDYLVKTQNAQGRWDEKYFTGNWLP

SEQ ID NO: 316 - protein, 231 aa, Unknown
  uncultured organism
SPVWDTAWAVIGLCESGMERTHPAVRSAIRWLYSMQILRPGDWAVKNPLTEPGGWAFEFHNDFYPDNDDTAAVLMGLLFSDLNDEENHRAFERGVRWLLSMQNNDSGWGAFERNVDNKIFDQIPFNDQKNMLDPSTADVTGRVVELLGRIGRRLGGSFSDEPYVRQAIEFLKNEQEPEGCWFGRWGVNYIYGTWSVLVALEAIGESMRAPYIRKAVNWVKKVQNPDGGWGE

SEQ ID NO: 317 - protein, 226 aa, Unknown
  uncultured organism
  misc_feature (105)..(105): Xaa can be any naturally occurring amino acid
  misc_feature (202)..(202): Xaa can be any naturally occurring amino acid
SPVWDTILGMIGLVDCGHDGKDPLLVTARDWIVKRQLLVNYGDWKVYNPNGPSGGWSFEYDNSWYPDVDDTAAIVIGFLKQDYEFRHSEVVKRACDWIASMQNQXGGWAAFDINNDKTFLNEIPFSDMESLCDPSSPDVVGRVLEAFGILNDPKYAEVCRRGIEYLRRTQESEGSWFGRWGVNYVYGTSNVLCSLKRQDVAXKDPMVTRALTWLKKVQNKDGGWGE

SEQ ID NO: 318 - protein, 225 aa, Unknown
  uncultured organism
SPVWDTGLALHALLESGMDPDDPAIAKAMHWLDEREITDVAGDWAEQRPGLAPGGWAFQYRNDHYPDVDDTAVVGMAMHRANPQARPETLERTRAWIEGMQSQNGGWGAFDADNTHYHLNHIPFADHGAMLDPPTADVSARCLGMLSQMGYDRDHPSIQRAIAYLKNDQEEDGSWFGRWGTNYIYGTWSVLSALNAAGEDMSQPYIRKAVDYLTNFQREDGGWGE

SEQ ID NO: 319 - protein, 225 aa, Unknown
  uncultured organism
SPVWDTSLSAHALMEAGLEENDKRLEGLLDWLKDLQILDVKGDWVARRPDVRPGGWAFQYRNDHYPDVDDTAVVAMAMHRQGDEKYKEAIDRAAEWIVGMQSSSGGWGAFDPENEHFYLNSIPFADHGALLDPPTEDVTARCVGFLAQLDPDAYAEPIKRGVEFLKRTQQEDGSWWGRWGANFVYGTWSVLCALNAAGEDPKSPYIQKAVAWLKSRQREDGGWGE

SEQ ID NO: 320 - protein, 225 aa, Unknown
  uncultured organism
  misc_feature (163)..(163): Xaa can be any naturally occurring amino acid
SPVWDTCLGLHALLEAGEPREAPSVKKAVDWLLEREITETYGDWVWRRPHLKPSGWAFQYWNNYYPDVDDTAVVVMALDRVGDPRCRPAIERACEWIIGMQSTSGGWGSFDPENEFTYLNHIPFADHGALLDPPTVDVTARCISMLAQVGYRHDHPAIRKSVXFILREQEKDGSWYGRWGTNYVYGTWSALSALNAVGEDMSSPVVRKGVAWLEAFQQPDGGWGE

SEQ ID NO: 321 - protein, 225 aa, Unknown
  uncultured organism
  misc_feature (129)..(129): Xaa can be any naturally occurring amino acid
  misc_feature (136)..(136): Xaa can be any naturally occurring amino acid
  misc_feature (193)..(193): Xaa can be any naturally occurring amino acid
  misc_feature (208)..(208): Xaa can be any naturally occurring amino acid
  misc_feature (215)..(215): Xaa can be any naturally occurring amino acid
SPVWDTGIACQALQEVGGPAADAGVQRALDWLVERQLRDEPGDWRRDRPDLEGGGWAFQYNNPHYPDLDDTSMVAWVMQVADHGRYREEIRRAAKWVVGMRSEGGGFASFEVDNTYYYLNHIPFADHGXLLDPPTXDVTARCIAVLAITDRAQHETVIREAIDFLFVDQEEDGSWFGRWGTDYIYGTWSVLSXLDVVGFDMRDARVRXSVEWLFXQQNPDGGWGE

SEQ ID NO: 322 - protein, 224 aa, Unknown
  uncultured organism
SPVWDTGIAAHALGEAGHASAMQSTADWLLTKEVRRKGDWSVKRPDVEPSGWYFEFANEFYPDIDDTAQVLLGLAHAKASDPAKQKACMDRAVAWLLAMQGSDGGWAAFDVDNNWEFLSSVPFADHNAMLDPTCPDITGRVLEALAACGVPNSHPAVKRGVEFLRNSVEKDGSWYGRWGVNYIYGTYLALRGLRASGEDDREAHILRAGEWLRAIQNADGGWGE

SEQ ID NO: 323 - protein, 224 aa, Unknown
  uncultured organism
SPMWDTSLAAHAFLESGDREDPRLIRALDWLVDKQILDHVGDWAVRRPGLRPGGWAFQYENPDYPDVDDTAVVAMAMHRTDPERYAENIDRACEWLAGMQSKNGGWGAFDPENEHYYLNSIPFADHGALLDPPTVDVTARCIGCLAQVDAEAFADNIKRGIGFIKREQEPDGSWFGRWGANYIYGTWSALVALKGAGEDMSQPYIRKSVAWLKGRQGPDGGWGE

SEQ ID NO: 324 - protein, 224 aa, Unknown
  uncultured organism
SPVWDTSLAAHALLEAGEPNDPEVIGLLDWLKDKQILTTVGDWSARRPNLRPGGWAFQYENPHYPDVDDTAVVAMAMHRQGDPKYAEAIARACEWLAGMQSSSGGWGAFDPENEHFYLNSIPFADHGALLDPPTVDVTARCVGCLAQVDAERFASEIQAGIDYIKREQEEDGSWFGRWGANYVYGTWSALVALNKAGEDMNTPYIRRAVDWLKARQRPDGGWGE

SEQ ID NO: 325 - protein, 640 aa, Verrucomicrobium spinosum
MATSDPSLAEAIQNTRAHLLSLRNARGHWEGHLSNSALSTATAIVALHLVDAPLHSARIAQGVRWLVLHQNKDGGWGDTTLSKSNLSTTLLCWSALSLCEPDRTEPIQHCEAWIKERTGSLEPEVICRAVVARYGKDKTFSVPILMLCAIGGRLGPEKEAWSRVLALPFELAAMPREWFGAIGLPVVSYALPALIAIGYARFYHAPPSLLNPLHALRKALWPRISPMLKLLQPSTGGYLEATPLTSFVTMALASAGEKFHPCVPEAVRFLEDSQRPDGSWPIDTNLATWGTTLSTKALTATSEGREALDIPALKSWLLEQQYQEIHPFTNAAPGGWAWTDLPGGVPDADDTSGALVALWHLCEDEAERQALAPAVAKGVQWLMDLQNRDGGIPTFCRGWGTLPFDRSTPEITAHALHAWGLWQVVLPEELQQEVSLRIPRAIAFIARPPSRGAPGFNHVPLWFGNEHAKEEENHVYGTAQIMNHLLSSGLNTPEIKVILETGHRNLLAWQQLDGGWSGSETGPASLEETAVSVAALALHTLHAGNRTRSSAEDAVAKGTQWLVQHTATGTTFPSAPIGLYFARLWYHEQLYPVIWTLGALHAVETLSAAALPLRARASAPPQHPGVVRTKPIHIAPPSDP

SEQ ID NO: 326 - protein, 649 aa, Acidiphilium cryptum
MFDTISFDFDALDQAISRAHARLSAEQRADGHYVYELEADATIPAEYVLLEHFLDRIDPELEARIGVFLRGIQGNSPQNPGGWPLFHDGAMDISASVKAYFALKAIGDDPDAPHMRRAREAILARGGAARTNVFTRIQLALFGAVPWRACPVMPVEIMLLPDWFPITIWKISYWSRTVIAPLLVLLTERPIARNPRNVRIDELFVTPPDQVTDYIRGPYRSNWGYLFKAIDSALRPLERHFPARSRKRAIQAAIDFITPRLNGEDGLGAIYPAMANTVMMYHTLGYSPDHPDYATAWASVRKLVTDASYRFEGASYVQPCLSPVWDTSLAAHALAEAGSPGDAQLAAACDWLIPRQILDVKGDWAYRKPDAPPGGWAFQYNNAHYPDVDDTAVVGMILDRNGDPAHREAVERARQWILGMQSRSGGWGAFDSDNEFHYLNHIPFADHGALLDPPTADVTARCISFLAQLGHAEDRPAIERGVAYLRREQEQDGSWFGRWGTNYIYGTWSSLCALNAAGVAQDDPMMVRAVEWLLARQRPDGGWGEDCETYAHAKPGEYHESLPSQTAWALLGLMAAGQAEHEAVARGIAWLQSVQEDDGSWTEQPYNAVGFPRVFYLRYHGYPRFFPLLAMARYRNLARGNSRQVQFGF

SEQ ID NO: 327 - DNA, 25 bp, Artificial
  PCR Primer
gcgctgtttcatatgggtattgaca

SEQ ID NO: 328 - DNA, 25 bp, Artificial
  PCR Primer
gcgcttaccctggatcctcgaaaat

SEQ ID NO: 329 - DNA, 1029 bp, Candida antarctica
atgaagctactctctctgaccggtgtggctggtgtgcttgcgacttgcgttgcagccactcctttggtgaagcgtctaccttccggttcggaccctgccttttcgcagcccaagtcggtgctcgatgcgggtctgacctgccagggtgcttcgccatcctcggtctccaaacccatccttctcgtccccggaaccggcaccacaggtccacagtcgttcgactcgaactggatccccctctcaacgcagttgggttacacaccctgctggatctcacccccgccgttcatgctcaacgacacccaggtcaacacggagtacatggtcaacgccatcaccgcgctctacgctggttcgggcaacaacaagcttcccgtgcttacctggtcccagggtggtctggttgcacagtggggtctgaccttcttccccagtatcaggtccaaggtcgatcgacttatggcctttgcgcccgactacaagggcaccgtcctcgccggccctctcgatgcactcgcggttagtgcaccctccgtatggcagcaaaccaccggttcggcactcaccaccgcactccgaaacgcaggtggtctgacccagatcgtgcccaccaccaacctctactcggcgaccgacgagatcgttcagcctcaggtgtccaactcgccactcgactcatcctacctcttcaacggaaagaacgtccaggcacaggccgtgtgtgggccgctgttcgtcatcgaccatgcaggctcgctcacctcgcagttctcctacgtcgtcggtcgatccgccctgcgctccaccacgggccaggctcgtagtgcagactatggcattacggactgcaaccctcttcccgccaatgatctgactcccgagcaaaaggtcgccgcggctgcgctcctggcgccggcagctgcagccatcgtggcgggtccaaagcagaactgcgagcccgacctcatgccctacgcccgcccctttgcagtaggcaaaaggacctgctccggcatcgtcaccccctga

SEQ ID NO: 330 - protein, 342 aa, Candida antarctica
MKLLSLTGVAGVLATCVAATPLVKRLPSGSDPAFSQPKSVLDAGLTCQGASPSSVSKPILLVPGTGTTGPQSFDSNWIPLSTQLGYTPCWISPPPFMLNDTQVNTEYMVNAITALYAGSGNNKLPVLTWSQGGLVAQWGLTFFPSIRSKVDRLMAFAPDYKGTVLAGPLDALAVSAPSVWQQTTGSALTTALRNAGGLTQIVPTTNLYSATDEIVQPQVSNSPLDSSYLFNGKNVQAQAVCGPLFVIDHAGSLTSQFSYVVGRSALRSTTGQARSADYGITDCNPLPANDLTPEQKVAAAALLAPAAAAIVAGPKQNCEPDLMPYARPFAVGKRTCSGIVTP

The invention claimed is:

1. A method for isolating the 3-(E)-isomer of an unsaturated carboxylic acid compound of the general formula (I)

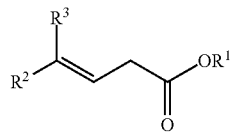

(I)

wherein
$R^1$ is H or a straight chain or branched, saturated or unsaturated $C_1$-$C_{20}$ hydrocarbyl residue;
$R^3$ is H or a $C_1$-$C_4$-hydrocarbyl residue;
$R^2$ is a straight chain or branched saturated or unsaturated $C_1$-$C_{20}$-hydrocarbyl residue;

with the proviso that, if $R^3$ is a $C_1$-$C_4$-hydrocarbyl residue, $R^2$ represents an hydrocarbyl residue containing at least one additional carbon atom;

from a mixture of isomers comprising the 3-(E)- and 3-(Z)-isomer of said carboxylic acid compound, whereby said mixture of isomers is subjected to a lipase (E.C. 3.1.1.3) catalyzed enzymatic conversion reaction, which lipase preferentially converts said 3-(E)-isomer, and the conversion product of said 3-(E)-isomer is isolated from said reaction mixture, wherein said lipase is *Candida antarctica* lipase B (CALB) comprising the amino acid sequence of SEQ ID NO: 330, or a mutant thereof having up to 15 amino acid substitutions, and retaining said 3-(E)-selectivity.

2. The method of claim 1, wherein said conversion reaction comprises an enzymatic esterification reaction of an acid of the formula (Ia);

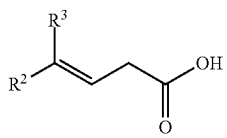

(Ia)

wherein
R² and R³ are as defined above;
and wherein the 3-(E)-ester is predominantly formed.

3. The method of claim 1, wherein said conversion reaction comprises an enzymatic ester cleavage reaction of an ester of the formula (Ib);

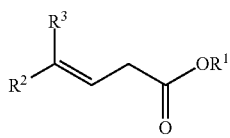

(Ib)

wherein
R¹ is a straight chain or branched, saturated or unsaturated $C_1$-$C_{20}$-hydrocarbyl residue;
and R² and R³ are as defined above;
and wherein the 3-(E)-acid is predominantly formed.

4. The method of claim 1, wherein said conversion reaction is performed in an organic solvent or aqueous-organic solvent.

5. The method of claim 1, wherein said carboxylic acid compound is a 3-(E)/7-(E)-homofarnesoic acid compound of formula (II)

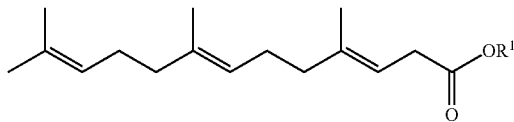

(II)

wherein R¹ is as defined above.

6. A method of preparing an unsaturated 3-(E)-carboxylic acid of the general formula (Ia):

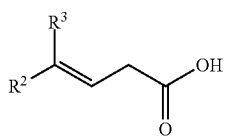

(Ia)

wherein
R² and R³ are as defined above;
wherein
a) an isomer mixture, comprising the 3-(E)- and the 3-(Z)-isomer of said carboxylic acid of formula (Ia) is subjected to an enzymatic esterification reaction in the presence of an alkanol of the formula R¹OH, wherein R¹ is a straight chain or branched, saturated or unsaturated $C_1$-$C_{20}$-hydrocarbyl residue; and in the presence of a lipase enzyme as defined in claim 1;

b) said 3-(E)-carboxylic ester as formed in step a) is isolated; and
c) said isolated ester of step b) is saponified to the corresponding 3-(E)-carboxylic acid of formula (Ia).

7. A method of preparing an unsaturated 3-(E)-carboxylic acid of the general formula (Ia):

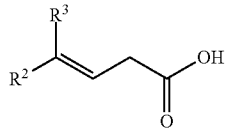

(Ia)

wherein
R² and R³ are as defined above;
wherein
a) an isomer mixture, comprising the 3-(E)- and the 3-(Z)-isomer of a carboxylic acid ester of formula (Ib)

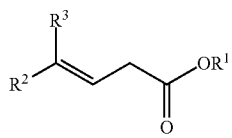

(Ib)

wherein
R¹ is a straight chain or branched, saturated or unsaturated $C_1$-$C_{20}$-hydrocarbyl residue; and
R² and R³ are as defined above;
is subjected to an enzymatic ester cleavage reaction in the presence of a lipase enzyme as defined in claim 1;
b) said 3-(E)-carboxylic acid as formed in step a) is isolated.

8. The method of claim 6, the enzymatic esterification reaction is performed in an organic solvent or aqueous-organic solvent.

9. The method of claim 1, wherein said 3-(E)-isomer of an unsaturated carboxylic acid is 3-(E)/7-(E)-homofarnesoic acid.

10. The method of claim 1 wherein said isomer mixture comprises a mixture of 3-(E)/7-(E)-homofarnesoic acid and 3-(Z)/7-(E)-homofarnesoic acid; or a mixture of 3-(E)/7-(E)-homofarnesoic acid ester and 3-(Z)/7-(E)-homofarnesoic acid ester of an alkanol of the formula R¹OH, wherein R¹ is a straight chain or branched, saturated or unsaturated $C_1$-$C_{20}$-hydrocarbyl residue.

11. The method of claim 10 for preparing 3-(E)/7-(E)-homofarnesoic acid wherein
a) an isomer mixture, comprising 3-(E)/7-(E)-homofarnesoic acid and 3-(Z)/7-(E)-homofarnesoic acid is subjected to an enzymatic esterification reaction in the presence of an alkanol of the formula R¹OH, wherein R¹ is a straight chain or branched, saturated or unsaturated $C_1$-$C_{20}$-hydrocarbyl residue; and in the presence of the lipase enzyme in an organic solvent or aqueous-organic solvent
b) said 3-(E)/7-(E)-homofarnesoic acid ester as formed in step a) is separated from unreacted acid by distillation or extraction; and
c) said isolated 3-(E)/7-(E)-homofarnesoic acid ester is saponified to 3-(E)/7-(E)-homofarnesoic acid.

12. The method of claim 10 for preparing 3-(E)/7-(E)-homofarnesoic acid
wherein
a) an isomer mixture, comprising 3-(E)/7-(E)-homofarnesoic acid ester and 3-(Z)/7-(E)-homofarnesoic acid ester is subjected to an enzymatic ester cleavage reaction in the presence of the lipase enzyme in an organic solvent or aqueous-organic solvent or in the presence of water; and
b) said 3-(E)/7-(E)-homofarnesoic acid as formed in step a) is separated from unreacted ester by distillation or extraction.

13. The method of claim 3, wherein $R^1$ is a straight chain or branched, saturated or unsaturated $C_4$-$C_{20}$-hydrocarbyl residue.

\* \* \* \* \*